(12) United States Patent
Niitsu et al.

(10) Patent No.: US 10,196,637 B2
(45) Date of Patent: *Feb. 5, 2019

(54) RETINOID-LIPID DRUG CARRIER

(71) Applicant: Nitto Denko Corporation, Osaka (JP)

(72) Inventors: Yoshiro Niitsu, Hokkaido (JP); Victor Knopov, Oceanside, CA (US); Joseph E. Payne, San Diego, CA (US); Richard P. Witte, San Diego, CA (US); Mohammad Ahmadian, Carlsbad, CA (US); Loren A. Perelman, San Diego, CA (US); Violetta Akopian, Oceanside, CA (US); Yasunobu Tanaka, Osaka (JP); Elena Feinstein, Rehovot (IL); Sharon Avkin-Nahum, Nes Ziona (IL); Hagar Kalinski, Rishon Le-Zion (IL); Igor Mett, Rehovot (IL); Kenjiro Minomi, Osaka (JP); Wenbin Ying, San Diego, CA (US); Yun Liu, San Diego, CA (US); Zheng Hou, San Diego, CA (US); John A. Gaudette, Poway, CA (US); Priya Karmali, San Diego, CA (US); Sridhar C. Nagarajan, San Diego, CA (US)

(73) Assignee: Nitto Denko Corporation, Osaka (JP)

( * ) Notice: Subject to any disclaimer, the term of this patent is extended or adjusted under 35 U.S.C. 154(b) by 0 days.

This patent is subject to a terminal disclaimer.

(21) Appl. No.: 15/284,494

(22) Filed: Oct. 3, 2016

(65) Prior Publication Data
US 2017/0081663 A1 Mar. 23, 2017

Related U.S. Application Data

(60) Continuation-in-part of application No. 14/294,021, filed on Jun. 2, 2014, now Pat. No. 9,456,984, which is a continuation of application No. 13/492,594, filed on Jun. 8, 2012, now Pat. No. 8,741,867, application No. 15/284,494, which is a continuation-in-part of application No. 15/177,284, filed on Jun. 8, 2016, now Pat. No. 10,100,004, which is a continuation of application No. 13/492,424, filed on Jun. 8, 2012, now Pat. No. 9,393,315, application No. 15/284,494, which is a continuation-in-part of application No. 15/005,569, filed on Jan. 25, 2016, now Pat. No. 9,963,424, which is a continuation of application No. 14/256,306, filed on Apr. 18, 2014, now Pat. No. 9,242,001, which is a division of application No. 13/492,650, filed on Jun. 8, 2012, now Pat. No. 9,011,903.

(60) Provisional application No. 61/494,832, filed on Jun. 8, 2011, provisional application No. 61/494,840, filed on Jun. 8, 2011, provisional application No. 61/494,710, filed on Jun. 8, 2011.

(51) Int. Cl.
| | |
|---|---|
| C12N 15/113 | (2010.01) |
| A61K 31/713 | (2006.01) |
| A61K 47/18 | (2017.01) |
| A61K 47/24 | (2006.01) |
| A61K 9/127 | (2006.01) |
| C07H 21/02 | (2006.01) |
| C12N 15/11 | (2006.01) |
| A61K 45/06 | (2006.01) |

(52) U.S. Cl.
CPC ............ *C12N 15/113* (2013.01); *A61K 9/127* (2013.01); *A61K 9/1271* (2013.01); *A61K 31/713* (2013.01); *A61K 45/06* (2013.01); *A61K 47/18* (2013.01); *A61K 47/186* (2013.01); *A61K 47/24* (2013.01); *C07H 21/02* (2013.01); *C12N 15/111* (2013.01); *C12N 2310/11* (2013.01); *C12N 2310/14* (2013.01); *C12N 2320/32* (2013.01)

(58) Field of Classification Search
CPC .............. A01K 2207/05; C12N 15/113; C12N 2310/11; C12N 2310/14; C12N 2310/32
See application file for complete search history.

(56) References Cited

U.S. PATENT DOCUMENTS

| | | |
|---|---|---|
| 4,501,729 A | 2/1985 | Boucher et al. |
| 4,830,858 A | 5/1989 | Payne et al. |
| 5,138,045 A | 8/1992 | Cook et al. |
| 5,214,136 A | 5/1993 | Lin et al. |
| 5,624,803 A | 4/1997 | Noonberg et al. |
| 5,811,119 A | 9/1998 | Mehta et al. |
| 5,898,031 A | 4/1999 | Crooke |
| 5,958,894 A | 9/1999 | Heath et al. |
| 6,107,094 A | 8/2000 | Crooke |
| 6,153,737 A | 11/2000 | Manoharan et al. |

(Continued)

FOREIGN PATENT DOCUMENTS

| | | |
|---|---|---|
| CN | 101855237 A | 10/2010 |
| DE | 19641672 | 4/1998 |

(Continued)

OTHER PUBLICATIONS

Chiu et al. RNA 2003 9:1034-1048 (Year: 2003).*

(Continued)

*Primary Examiner* — Brian A Whiteman
(74) *Attorney, Agent, or Firm* — Baker & Hostetler LLP

(57) ABSTRACT

What is described is a pharmaceutical composition for treating a fibrotic disease comprising a drug carrier, which comprises a lipid and a retinoid, and a double-stranded nucleic acid molecule, which comprises an antisense sequence to mRNA encoding human hsp47.

20 Claims, 33 Drawing Sheets

Specification includes a Sequence Listing.

(56) References Cited

U.S. PATENT DOCUMENTS

| | | |
|---|---|---|
| 6,180,613 B1 | 1/2001 | Kaplitt et al. |
| 6,235,886 B1 | 5/2001 | Manoharan et al. |
| 6,270,806 B1 | 8/2001 | Liversidge et al. |
| 6,335,434 B1 | 1/2002 | Guzaev et al. |
| 6,372,714 B1 | 4/2002 | Tanaka et al. |
| 6,468,551 B1 | 10/2002 | Diec et al. |
| 6,528,631 B1 | 3/2003 | Cook et al. |
| 6,534,484 B1 | 3/2003 | Wheeler et al. |
| 6,565,885 B1 | 5/2003 | Tarara et al. |
| 6,582,728 B1 | 6/2003 | Platz et al. |
| 6,586,410 B1 | 7/2003 | Wheeler et al. |
| 6,586,524 B2 | 7/2003 | Sagara |
| 6,592,904 B2 | 7/2003 | Platz et al. |
| 6,602,858 B2 | 8/2003 | Beigelman |
| 6,613,735 B2 | 9/2003 | Tanaka et al. |
| 6,635,683 B1 | 10/2003 | Taira et al. |
| 6,815,432 B2 | 11/2004 | Wheeler et al. |
| 6,858,224 B2 | 2/2005 | Wheeler et al. |
| 6,858,225 B2 | 2/2005 | Semple et al. |
| 7,452,987 B2 | 11/2008 | Giese et al. |
| 7,799,565 B2 | 9/2010 | MacLachlan et al. |
| 7,803,397 B2 | 9/2010 | Heyes et al. |
| 7,807,815 B2 | 10/2010 | MacLachlan et al. |
| 7,811,602 B2 | 10/2010 | Cullis et al. |
| 7,833,992 B2 | 11/2010 | Vargeese et al. |
| 7,901,708 B2 | 3/2011 | MacLachlan et al. |
| 7,915,399 B2 | 3/2011 | MacLachlan et al. |
| 7,982,027 B2 | 7/2011 | MacLachlan et al. |
| 8,058,069 B2 | 11/2011 | Yaworski et al. |
| 8,173,170 B2 | 5/2012 | Niitsu et al. |
| 8,178,124 B2 | 5/2012 | Niitsu et al. |
| 8,664,376 B2 | 3/2014 | Niitsu et al. |
| 8,710,209 B2 | 4/2014 | Jin et al. |
| 8,741,867 B2 * | 6/2014 | Niitsu .................. C12N 15/111 514/44 A |
| 9,011,903 B2 * | 4/2015 | Niitsu .................. A61K 47/186 424/450 |
| 9,206,424 B2 | 12/2015 | Jin et al. |
| 9,242,001 B2 * | 1/2016 | Niitsu .................. A61K 47/186 |
| 9,393,315 B2 * | 7/2016 | Niitsu ...................... C07F 9/10 |
| 9,456,984 B2 * | 10/2016 | Niitsu .................. C12N 15/111 |
| 9,944,671 B2 * | 4/2018 | Hinkle ................... C07H 21/02 |
| 9,963,424 B2 * | 5/2018 | Niitsu .................. C07C 237/08 |
| 2001/0038851 A1 | 11/2001 | Allen et al. |
| 2003/0064094 A1 | 4/2003 | Frankenberger et al. |
| 2003/0077829 A1 | 4/2003 | MacLachlan |
| 2003/0130186 A1 | 7/2003 | Vargeese et al. |
| 2003/0161791 A1 * | 8/2003 | Bentley ................ A61K 9/0075 424/46 |
| 2004/0037780 A1 | 2/2004 | Parsons et al. |
| 2004/0142025 A1 | 7/2004 | MacLachlan et al. |
| 2005/0244858 A1 | 11/2005 | Rossi et al. |
| 2006/0134189 A1 | 6/2006 | MacLachlan et al. |
| 2006/0240093 A1 | 10/2006 | MacLachlan et al. |
| 2007/0042031 A1 | 2/2007 | MacLachlan et al. |
| 2007/0117841 A1 | 5/2007 | Ozes et al. |
| 2007/0128118 A1 | 6/2007 | Yu et al. |
| 2007/0161596 A1 * | 7/2007 | McSwiggen ......... C12N 15/113 514/44 A |
| 2008/0193512 A1 * | 8/2008 | Niitsu .................. A61K 9/0019 424/450 |
| 2008/0253969 A1 | 10/2008 | Yu et al. |
| 2008/0274116 A1 | 11/2008 | Keil et al. |
| 2008/0279778 A1 | 11/2008 | Van et al. |
| 2008/0279782 A1 | 11/2008 | Van et al. |
| 2009/0105179 A1 * | 4/2009 | Yu ........................ A61K 31/337 514/44 R |
| 2009/0163705 A1 | 6/2009 | Manoharan et al. |
| 2009/0226393 A1 | 9/2009 | Wang et al. |
| 2009/0247608 A1 | 10/2009 | Manoharan et al. |
| 2010/0028416 A1 | 2/2010 | Yu et al. |
| 2010/0130588 A1 | 5/2010 | Yaworski et al. |
| 2010/0233275 A1 | 9/2010 | Saulnier et al. |
| 2010/0266676 A1 | 10/2010 | Saulnier et al. |
| 2010/0297247 A1 | 11/2010 | Anton et al. |
| 2010/0330166 A1 | 12/2010 | Ishida et al. |
| 2010/0331234 A1 | 12/2010 | Mahon et al. |
| 2011/0040113 A1 | 2/2011 | Wu et al. |
| 2011/0104255 A1 | 5/2011 | Niitsu et al. |
| 2011/0200527 A1 | 8/2011 | Xu et al. |
| 2012/0269886 A1 | 10/2012 | Niitsu et al. |
| 2013/0022665 A1 | 1/2013 | Niitsu et al. |
| 2013/0071467 A1 | 3/2013 | Niitsu et al. |
| 2013/0071478 A1 | 3/2013 | Niitsu et al. |
| 2013/0171127 A1 | 7/2013 | Yoshiro et al. |
| 2013/0171240 A1 | 7/2013 | Yoshiro et al. |
| 2013/0210744 A1 | 8/2013 | Yoshiro et al. |
| 2014/0356413 A1 | 12/2014 | Niitsu et al. |
| 2016/0108399 A1 | 4/2016 | Jin et al. |

FOREIGN PATENT DOCUMENTS

| | | |
|---|---|---|
| EP | 0586520 A1 | 3/1994 |
| EP | 0618925 A1 | 10/1994 |
| EP | 1842557 A1 | 10/2007 |
| JP | 61-089286 | 5/1986 |
| JP | 61-136584 | 6/1986 |
| JP | 61-254634 | 11/1986 |
| JP | 01-232250 | 9/1989 |
| JP | 4-001239 | 1/1992 |
| JP | 4-108536 | 4/1992 |
| JP | 4-315042 | 11/1992 |
| JP | 2001-501639 A | 2/2001 |
| JP | 2005-507934 A | 3/2005 |
| JP | 2006-254877 | 9/2006 |
| JP | 2006-522140 A | 9/2006 |
| JP | 2009-013145 | 1/2009 |
| JP | 2010-539245 A | 12/2010 |
| TW | 201000134 A | 1/2010 |
| WO | WO 1989/02439 A1 | 3/1989 |
| WO | WO 1992/20823 A1 | 11/1992 |
| WO | WO 1993/13121 A1 | 7/1993 |
| WO | WO 1993/23569 A1 | 11/1993 |
| WO | WO 1994/02595 A1 | 2/1994 |
| WO | WO 1995/06731 A2 | 3/1995 |
| WO | WO 1995/11910 A1 | 5/1995 |
| WO | WO 1996/18736 A2 | 6/1996 |
| WO | WO 1998/13025 | 4/1998 |
| WO | WO 1998/39352 A1 | 9/1998 |
| WO | WO 98/45463 | 10/1998 |
| WO | WO 1999/07409 A1 | 2/1999 |
| WO | WO 1999/14226 A2 | 3/1999 |
| WO | WO 1999/32619 A1 | 7/1999 |
| WO | WO 1999/61631 A1 | 12/1999 |
| WO | WO 2000/01846 A2 | 1/2000 |
| WO | WO 2000/007004 | 2/2000 |
| WO | WO 2000/44895 A1 | 8/2000 |
| WO | WO 2000/44914 A1 | 8/2000 |
| WO | WO 2000/47599 A1 | 8/2000 |
| WO | WO 2001/29058 A1 | 4/2001 |
| WO | WO 2001/36646 A1 | 5/2001 |
| WO | WO 2001/75164 A2 | 10/2001 |
| WO | WO 2003/009881 A2 | 2/2003 |
| WO | WO 2003/037385 | 5/2003 |
| WO | WO 2003/037385 A1 | 5/2003 |
| WO | WO 2004/013280 A2 | 2/2004 |
| WO | WO 2004/083430 A2 | 9/2004 |
| WO | WO 2004/089311 A2 | 10/2004 |
| WO | WO 2005/054486 | 6/2005 |
| WO | WO 2006/047842 A2 | 5/2006 |
| WO | WO 2006/068232 A1 | 6/2006 |
| WO | WO 2007/099650 | 9/2007 |
| WO | WO 2008/049078 A1 | 4/2008 |
| WO | WO 2008/055628 | 5/2008 |
| WO | WO 2008/132723 A2 | 11/2008 |
| WO | WO 2009/004214 | 1/2009 |
| WO | WO 2009/036368 A2 | 3/2009 |
| WO | WO 2009/037310 | 3/2009 |
| WO | WO 2009/046974 | 4/2009 |
| WO | WO 2009/046975 | 4/2009 |
| WO | WO 2009/095226 | 8/2009 |
| WO | WO 2009/096487 | 8/2009 |
| WO | WO 2009/116257 | 9/2009 |

(56) References Cited

FOREIGN PATENT DOCUMENTS

| WO | WO 2010/014117 A1 | 2/2010 |
|---|---|---|
| WO | WO 2010/029760 A1 | 3/2010 |
| WO | WO 2010/061880 | 6/2010 |
| WO | WO 2010/065787 A2 | 6/2010 |
| WO | WO 2011/072082 A2 | 6/2011 |
| WO | WO 2012/170957 A2 | 12/2012 |

OTHER PUBLICATIONS

China Patent Application No. 201280028300.X; Office Action; dated Nov. 4, 2014; 10 pages.
European Patent Application No. 12730301.4; Article 94(3); dated Dec. 15, 2014; 5 pages.
Albanis et al., "Treatment of Hepatic Fibrosis: Almost There", Curr. Gastroenterol. Rep., 2003, 5, 48-56.
Allshire, "RNAi and Heterochromatin—A Hushed-Up Affair", Science, Sep. 13, 2002, 297, 1818-1819.
Bahramian et al., "Transcriptional and Posttranscriptional Silencing of Rodent .alpha.1(I) Collagen by a Homologous Transcriptionally Self-Silenced Transgene", Mol. Cell. Bio., Jan. 1999, 19(1), 274-283.
Bass, "Double-Stranded RNA as a Template for Gene Silencing", Cell, Apr. 28, 2000, 101, 235-238.
Bass, "RNA Interference: The Short Answer", Nature, May 2001, 411, 428-429.
Bernstein et al., "Role for a Bidentate Ribonuclease in the Initiation Step of RNA Interference", Nature, Jan. 18, 2001, 409, 363-366.
Blomhoff et al., "Hepatic Uptake of [3H} Retinol Bound to the Serum Retinol Binding Protein Involves Both Parenchymal and Perisinusoidal Stellate Cells", J. of Bio Chem, Nov. 1985, 260(25), 13571-13575.
Chen et al., "Multitarget-Ribozyme Directed to Cleave At Up to Nine Highly Conserved HIV-1 Env RNA Regions Inhibits HIV-1 Replication—Potential Effectiveness Against Most Presently Sequenced HIV-1 Isolates", Nucleic Acids Res., 1992, 20(17), 4581-4589.
Choi et al., "Effect of Poly(ethylene glycol) Grafting on Polyethylenimine as a Gene Transfer Vector in vitro", Bull. Korean Chem. Soc., 2001, 22(1), 46-52.
Chowrira et al., "In vitro and in Vivo Comparison of Hammerhead, Hairpin, and Hepatitis Delta Virus Self-Processing Ribozyme Cassettes", J. Biol. Chem., Oct. 1994, 269(41), 25856-25864.
Chua et al., "Pulmonary Fibrosis: Searching for Model Answers", Am. J. Respir. Cell Mol. Biol., 2005, 33, 9-13.
Cload et al., "Polyether Tethered Oligonucleotide Probes", J. Am. Chem. Soc., 1991, 113, 6324-6326.
Cordeiro et al., "Human Anti-Transforming Growth Factor-Beta2 Antibody: a New Glaucoma Anti-Scarring Agent", Invest Ophthalmol Vis. Sci., Sep. 1999, 40(10) 2225-2234.
Diebold et al., "Mannose Polyethylenimine Conjugates for Targeted DNA Delivery into Dendritic Cells", J. Biol. Chem., Jul. 1999, 274(27), 19087-19094.
Dropulic et al., "Functional Characterization of a U5 Ribozyme: Intracellular Suppression of Human Immunodeficiency Virus Type 1 Expression", J. Virol., Mar. 1992, 66(3), 1432-1441.
Durand et al., "Circular Dichroism Studies of an Oligodeoxyribonucleotide Containing a Hairpin Loop Made of a Hexaethylene Glycol Chain: Conformation and Stability", Nucleic Acids Res., 1990, 18(21), 6353-6359.
Elbashir et al., "Duplexes of 21-Nucleotide RNAs Mediate RNA Interference in Cultured Mammalian Cells", Nature, May 24, 2001, 411, 494-498.
Elbashir et al., "Functional Anatomy of siRNAs for Mediating Efficient RNAi in Drosophila melanogaster Embryo Lysate", EMBO J., 2001, 20(23), 6877-6888.
Elbashir et al., "RNA Interference is Mediated by 21 and 22 Nucleotide RNAs", Genes Dev., 2001, 15, 188-200.
Elroy et al., "Cytoplasmic Expression System Based on Constitutive Synthesis of Bacteriophage T7 RNA Polymerase in Mammalian Cells", Proc. Natl. Acad. Sci., Sep. 1990, 87, 6743-6747.

Epa et al., "Downregulation of the p75 Neurotrophin Receptor in Tissue Culture and In Vivo, Using .beta.-Cyclodextrin-Adamantane-Oligonucleotide Conjugates", Antisense Nucl. Acid Drug Dev., 2000, 10, 469-478.
Erbacher et al., "Transfection and Physical Properties of Various Saccharide, Poly(ethylene glycol), and Antibody-Derivatized Polyethylenimines (PEI)", J. Gene Med., 1999, 1, 210-222.
Fire et al., "Potent and Specific Genetic Interference by Double-Stranded RNA in Caenorhabditis elegans", Nature, Feb. 19, 1998, 391, 806-811.
Freier et al., "Improved Free-Energy Parameters for Predictions of RNA Duplex Stability", Proc. Natl. Acad. Sci., Dec. 1986, 83, 9373-9377.
Friedman, "Liver Fibrosis—From Bench to Bedside", J. Hepatol., 2003, 38, S38-S53.
Gao et al., "Cytoplasmic Expression of a Reporter Gene by Co-Delivery of T7 RNA Polymerase and T7 Promoter Sequence with Cationic Liposomes", Nucleic Acids Res., 1993, 21(12), 2867-2872.
GenBank Accession No. M69246.1, "Rat Collagen-Binding Protein (gp46) mRNA, Complete CDs", Apr. 1993, 2 pages.
GenBank Accession No. NM.sub.--001235.3, "Homo sapiens Serpin Peptidase Inhibitor, Clade H (Heat Shock Protein 47), Member 1, (Collagen Binding Protein 1) (SERPINH1), Transcript Variant 2, mRNA", Sep. 2012, 5 pages.
Godbey et al., "Poly(ethylenimine) and Its Role in Gene Delivery", J. Controlled Release, 1999, 60, 149-160.
Godbey et al., "Tracking the Intracellular Path of Poly(Ethylenimine)/DNA Complexes for Gene Delivery", Proc. Natl. Acad. Sci., Apr. 1999, 96, 5177-5181.
Gold et al., "Diversity of Oligonucleotide Functions", Annu. Rev. Biochem., 1995, 64, 763-797.
Good et al, "Expression of Small, Therapeutic RNAs in Human Cell Nuclei", Gene Ther, 1997, 4, 45-54.
Gross et al., "Medical Progress: Idiopathic Pulmonary Fibrosis", N. Engl. J. Med., Aug. 16, 2001, 345(7), 517-525.
Hall et al., "Establishment and Maintenance of a Heterochromatin Domain", Science, Sep. 27, 2002, 297, 2232-2237.
Hamilton et al., "A Species of Small Antisense RNA in Post-transcriptional Gene Silencing in Plants", Science, Oct. 29, 1999, 286, 950-952.
Hermann et al., "Adaptive Recognition by Nucleic Acid Aptamers", Science, Feb. 4, 2000, 287, 820-825.
Hutvagner et al., "A Cellular Function for the RNA-Interference Enzyme Dicer in the Maturation of the let-7 Small Temporal RNA", Science, Aug. 3, 2001, 293, 834-838.
Hutvagner et al., "A MicroRNA in a Multiple-Turnover RNAi Enzyme Complex", Science, Sep. 20, 2002, 297, 2056-2060.
International Patent Application No. PCT/US2012/041761: International Search Report and Written Opinion, dated Jan. 4, 2013, 13 pages.
Jaster, "Molecular Regulation of Pancreatic Stellate Cell Function", Mol. Cancer, Oct. 6, 2004, 3(26), 1-8.
Jayasena, "Aptamers: An Emerging Class of Molecules That Rival Antibodies in Diagnostics", Clinical Chemistry, 1999, 45(9), 1628-1650.
Jensen et al., "Unlocked Nucleic Acid (UNA) and UNA Derivatives: Thermal Denaturation Studies", Nucleic Acids Symposium Series No. 52, Sep. 8, 2008, 133-134.
Jenuwein, "An RNA-Guided Pathway for the Epigenome", Science, Sep. 27, 2002, 297, 2215-2218.
Kakugawa et al., "Pirfenidone Attenuates Expression of HSP47 in Murine Bleomycin-Induced Pulmonary Fibrosis", Eur. Respir. J., 2004, 24, 57-65.
Kang, "Retinoic Acid Alters the Intracellular Trafficking of the Mannose-6-Phosphate/Insulin Like Growth Factor II Receptor and Lysosomal Enzymes", Proc. Natl. Acad. Sci., Cell Biology, Nov. 1998, 95, 13687-13691.
Kazuhiro et al., "Oral Tolerance Induction by Type V Collagen Downregulates Lung Allograft Rejection", Am. J. Respir. Cell Mol. Biol., 2001, 25, 26-34.

(56) References Cited

OTHER PUBLICATIONS

Koide et al., "Specific Recognition of the Collagen Triple Helix by Chaperone HSP47: Minimal Structural Requirement and Spatial Molecular Orientation", J. Biol. Chem., Feb. 2006, 281(6), 3432-3438.

Koide et al., "Substrate Recognition of Collagen-Specific Molecular Chaperone HSP47: Structural Requirements and Binding Regulation", J. Biol. Chem., Dec. 3, 1999, 274(49), 34523-34526.

L'Huillier et al., "Cytoplasmic Delivery of Ribozymes Leads to Efficient Reduction in Alpha-lactalbumin mRNA Levels in C1271 Mouse Cells", EMBO J., 1992, 11(12), 4411-4418.

Lasky et al., "Interstitial Fibrosis and Growth Factors", Environ. Health Perspect., 2000, 108(Suppl. 4), 751-762.

Lin et al., "RNA Interference: Policing Rogue Genes", Nature, Nov. 11, 1999, 402, 128-129.

Lisziewicz et al., "Inhibition of Human Immunodeficiency Virus Type 1 Replication by Regulated Expression of a Polymeric Tat Activation Response RNA Decoy as a Strategy for Gene Therapy in Aids", Proc. Natl. Acad. Sci., Sep. 1993, 90, 8000-8004.

Ma et al., "Design and Synthesis of RNA Miniduplexes via a Synthetic Linker Approach. 2. Generation of Covalently Closed, Double-Stranded Cyclic HIV-1 TAR RNA Analogs with High Tat-Binding Affinity", Nucleic Acids Res., 1993, 21(11), 2585-2589.

Madro et al., "The Role of Pancreatic Stellate Cells and Cytokines in the Development of Chronic Pancreatitis", Med. Sci. Monit., 2004, 10(7), RA166-170.

Maeda et al., "A Novel Neuroprotectant Against Retinal Ganglion Cell Damage in a Glaucoma Model and an Optic Nerve Crush Model in the Rat", Invest. Ophthalmol. Vis. Sci., Mar. 2004, 45(3), 851-856.

Manabe et al., "Gene Expression in Fibroblasts and Fibrosis: Involvement in Cardiac Hypertrophy", Circ. Res., 2002, 91, 1103-1113.

Masuda et al., "Coexpression of the Collagen-Binding Stress Protein HSP47 Gene and the Alpha 1(1) and Alpha 1(III) Collagen Genes in Carbon Tetrachloride-Induced Rat Liver Fibrosis", J. Clin. Invest., Dec. 1994, 94, 2481-2488.

Masuda et al., "Expression and Localization of Collagen-Binding Stress Protein HSP47 in Mouse Embryo Development: Comparison with Types I and II Collagen", Cell Stress Chaperones, 1998, 3(4), 256-264.

McGarry et al., "Inhibition of Heat Shock Protein Synthesis by Heat-Inducible Antisense RNA", Proc. Natl. Acad. Sci., Jan. 1986, 83, 399-403.

McManus et al., "Gene Silencing Using Micro-RNA Designed Hairpins", RNA, 2002, 8, 842-850.

Moeller et al., "The Bleomycin Animal Model: A Useful Tool to Investigate Treatment Options for Idiopathic Pulmonary Fibrosis?", Int. J. Biochem. Cell Biol., 2008, 40(3), 362-382.

Moriyama et al., "Up-regulation of HSP47 in the Mouse Kidneys with Unilateral Ureteral Obstruction", Kidney Int., 1998; 54, 110-119.

Noonberg et al., "In vivo Generation of Highly Abundant Sequence-Specific Oligonucleotides for Antisense and Triplex Gene Regulation", Nucleic Acid Res., 1994, 22(14), 2830-2836.

Novina et al., "siRNA-Directed Inhibition of HIV-1 Infection", Nature Med., Jul. 2002, 8(7), 681-686.

Ogris et al., "DNA/Polyethylenimine Transfection Particles: Influence of Ligands, Polymer Size, and PEGylation on Internalization and Gene Expression", AAPS PharmSci, 2001, Article 21, 3(3), 1-11.

Ojwang et al., "Inhibition of Human Immunodeficiency Virus Type 1 Expression by a Hairpin Ribozyme", Proc. Natl. Acad. Sci., Nov. 1992, 89, 10802-10806.

Ono et al., "DNA Triplex Formation of Oligonucleotide Analogs Consisting of Linker Groups and Octamer Segments that have Opposite Sugar-Phosphate Backbone Polarities", Biochemistry, 1991, 30, 9914-9921.

Paul et al., "Effective Expression of Small Interfering RNA in Human Cells", Nature Biotech., May 2002, 20, 505-508.

Pinzani et al., "Liver Fibrosis: from the Bench to Clinical Targets", Dig. Liver Dis., Apr. 2004, 36, 231-242.

Qi et al., "Blockade of Type .beta. Transforming Growth Factor Signaling Prevents Liver Fibrosis and Dysfunction in the Rat", Proc Natl Acad Sci, Mar. 1999, 96, 2345-2349.

Reinhart et al., "MicroRNAs in Plants", Genes Dev, 2002, 16, 1616-1626.

Reinhart et al., "Small RNAs Correspond to Centromere Heterochromatic Repeats", Science, 2002, 297, 1831.

Sakaida et al., "Fibrosis Accelerates the Development of Enzyme-Altered Lesions in the Rat Liver", Hep., 1998, 28, 1247-1252.

Sato et al., "Resolution of Liver Cirrhosis Using Vitamin A—Coupled Liposomes to Deliver Sirna Against a Collagen-Specific Chaperone", Nature Biotechnol., Apr. 2008, 26(4), 431-442.

Scanlon et al., "Ribozyme-Mediated Cleavage of C-Fos mRNA Reduces Gene Expression of DNA Synthesis Enzymes and Metallothionein", Proc. Natl. Acad. Sci., Dec. 1991, 88, 10591-10595.

Seela et al., "Oligodeoxyribonucleotides Containing 1,3-Propanediol as Nucleoside Substitute", Nucleic Acids Res., 1987, 15(7), 3113-3129.

Sharp, "RNAi and Double-Strand RNA", Genes & Dev., 1999, 13, 139-141.

Shimizukawa et al., "Intratracheal Gene Transfer of Decorin Reduces Subpleural Fibroproliferation Induced by Bleomycin", Am. J. Physiol. Lung Cell Mol. Physiol., 2003, 284, L526-L532.

Simantov et al., "Dopamine-Induced Apoptosis in Human Neuronal Cells: Inhibition by Nucleic Acids Antisense to the Dopamine Transporter", Neuroscience, 1996, 74(1), 39-50.

Socaciu et al., "Different Ways to Insert Cartenoids into Liposomes Affect Structure and Dynamics of the Bilayer Differently", Biophysical Chemistry, 2002, 99, 1-15.

Sommer et al., "The Spread and Uptake Pattern of Intracerebrally Administered Oligonucleotides in Nerve and Glial Cell Populations of the Rat Brain", Antisense Nuc. Acid Drug Dev., 1998, 8(2), 75-85.

Swiderski et al., "Differential Expression of Extracellular Matrix Remodeling Genes in a Murine Model of Bleomycin-Induced Pulmonary Fibrosis", Am. J. Pathol., Mar. 1988, 152(3), 821-828.

Taira et al., "Construction of a Novel RNA-Transcript-Trimming Plasmid Which Can Be Used Both in Vitro in Place of Run-Off and (G)-Free Transcriptions and In Vivo as Multi-Sequences Transcription Vectors", Nucleic Acids Res., 1991, 19(19), 5125-5130.

Takei et al., "5'-,3'-Inverted Thymidine-Modified Antisense Oligodeoxynucleotide Targeting Midkine: Its Design and Application for Cancer Therapy", J. Biol. Chem., Jun. 28, 2002, 277(26), 23800-23806.

Thomas et al., "Enhancing Polyethylenimine's Delivery of Plasmid DNA Into Mammalian Cells", Proc. Natl. Acad. Sci., Nov. 12, 2002, 99(23), 14640-14645.

Thompson et al., "Improved Accumulation and Activity of Ribozymes Expressed From a tRNA-Based RNA Polymerase III Promoter", Nucleic Acids Res., 1995, 23(12), 2259-2268.

Ventura et al., "Activation of HIV-Specific Ribozyme Activity by Self-Cleavage", Nucleic Acids Res., 1993, 21(14), 3249-3255.

Volpe et al., "Regulation of Heterochromatic Silencing and Histone H3 Lysine-9 Methylation by RNAi", Science, Sep. 13, 2002, 297, 1833-1837.

Wang et al., "Antisense Oligonucleotide Against Collagen-Specific Molecular Chaperone 47kDa Heat Shock Protein Suppresses Scar Formation in Rat Wounds", Plast. Reconstr. Surg., May 2003, 111(6), 1980-1987.

Weerasinghe et al., "Resistance to Human Immunodeficiency Virus Type 1 (HIV-1) Infection in Human CD4+ Lymphocyte-Derived Cell Lines Conferred by Using Retroviral Vectors Expressing an HIV-1 RNA-Specific Ribozyme", J. Virol., Oct. 1991, 65(10), 5531-5534.

Whitmer et al., "Membrane-Membrane Interactions Associated with Rapid Transfer of Liposomal Bilirubin to Microsomal UDP-Glucuronyltransferase: Relevance for Hepatocellular Transport and Biotransformation of Hydrophobic Substrates", Biochem J., 1987, 244, 41-47.

(56) References Cited

OTHER PUBLICATIONS

Wianny et al., "Specific Interference with Gene Function by Double-Stranded RNA in Early Mouse Development", Nature Cell Biol., Feb. 2, 2000, 70-75.

Xu et al., "Molecular Classification of Liver Cirrhosis in a Rat Model by Proteomics and Bioinformatics", Proteomics, 2004, 4, 3235-3245.

Yu et al., "A Hairpin Ribozyme Inhibits Expression of Diverse Strains of Human Immunodeficiency Virus Type 1", Proc. Natl. Acad. Sci., Jul. 1993, 90, 6340-6344.

Zamore et al., "RNAi: Double-Stranded RNA Directs the ATP-Dependent Cleavage of mRNA at 21 to 23 Nucleotide Intervals", Cell, Mar. 31, 2000, 101, 25-33.

Zhou et al., "Synthesis of Functional mRNA in Mammalian Cells by Bacteriophage T3 RNA Polymerase", Mol. Cell. Biol., Sep. 1990, 10(9), 4529-4537.

Zhou et al., "The Role of SRC Family Kinases in Cortical Cataract Formation", Invest. Ophthalmol. Vis. Sci., Jul. 2002, 43(7), 2293-2300.

Japan Patent Application No. 2014-514911; Office Action—Reasons for Refusal; dated Jul. 30, 2015; 8 pages.

Taiwan Patent Application No. 101120615; Office Action; dated Nov. 20, 2015; 5 pages.

Russia Patent Application No. 2013158469/10; Office Action; dated Jan. 26, 2016; 6 pages.

GenBank Accession No. BC070087; "*Homo sapiens* serpin peptidase inhibitor, clade H (heat shock protein 47), member 1, (collagen binding protein 1), mRNA (cDNA clone MGC:87465 Image:5274406, complete cds"; Jul. 17, 2016; 3 pages.

King et al.; "Determination of Cobalt, Copper, Mercury, and Nickel as Bis(2-hydroxyethyl)dithiocarbamate Complexes by High-Performance Liquid Chromatography"; American Chemical Society; 1987; p. 703-708.

Taiwan Patent Application No. 101120615; Office Action; dated Jun. 28, 2016; 12 pages.

Australia Patent Application No. 2012267472; Office Action; dated Jul. 13, 2016; 3 pages.

Abu Lila et al., "Oxaliplatin encapsulated in PEG-coated cationic liposomes induces significant tumor growth suppression via a dual-targeting approach in a murine solid tumor model," Journal of Controlled Release, Jul. 1, 2009, 137(1), 8-14.

Abu Lila et al., "Oxaliplatin targeting to angiogenic vessels by PEGylated cationic liposomes suppresses the angiogenesis in a dorsal air sac mouse model," Journal of Controlled Release, Feb. 20, 2009, 134(1), 18-25.

Almofti et al., "Cationic liposome-mediated gene delivery: Biophysical study and mechanism of internalization," Archives of Biochemistry and Biophysics, Feb. 15, 2003, 410(2), 246-253.

Almofti et al., "Lipoplex size determines lipofection efficiency with or without serum," Molecular Membrane Biology, Jan.-Mar. 2003, 20(1), 35-43.

Brigelius-Flohe and Traber, "Vitamin E: function and metabolism," The FASEB Journal, Jul. 1999, 13(10), 1145-1155.

Feril et al., "Ultrasound enhances liposome-mediated gene transfection," Ultrasonics Sonochemistry, Aug. 2005, 12(6), 489-493.

Fingl et al., "The Pharmacological Basis of Therapeutics," Fourth Edition, 1975, Ch. 1, p. 1.

Hao et al., "Phorbol ester-potentiated liposomal transfection to monocytic PLB-985 cells," Journal of Biochemistry, Dec. 2000, 128(6), 989-998.

Ishiwata et al., "Characteristics and biodistribution of cationic liposomes and their DNA complexes," Journal of Controlled Release, Oct. 2000, 69(1), 139-148.

Justus et al., "Synthesis, Liposomal Preparation, and in Vitro Toxicity of Two Novel Dodecaborate Cluster Lipids for Boron Neutron Capture Therapy," Bioconjugate Chemistry, Jul.-Aug. 2007, 18(4),1287-1293.

Kikuchi et al., "Development of novel cationic liposomes for efficient gene transfer into peritoneal disseminated tumor," Human Gene Therapy, Apr. 1999, 10(6), 947-955.

Kusumoto et al., "Gene transfer effects on various cationic amphiphiles in CHO cells," Cytotechnology, Jun. 2006, 51(2), 57-66.

Nakashima et al., "Design of a Lipid Bilayer Electrical Device. Strong Chemical Structure Dependence and Molecular Mechanisms on the Phase Transition-Dependent Electrical Impedance Responses of the Device in Air," Journal of Physical Chemistry B, Jan. 1997, 101(2), 215-220.

Scatchard, G., "The attractions of proteins for small molecules and ions," Ann. NY Acad. Sci., May 1949, 51, Molecular Interaction, 660-672.

Serikawa et al., "A new cationic liposome for efficient gene delivery with serum into cultured human cells: a quantitative analysis using two independent fluorescent probes," Biochimica et Biophysica Acta, Biomembranes, Aug. 25, 2000, 1467(2), 419-430.

Serikawa et al., "Enhancement of Gene Expression Efficiency Using Cationic Liposomes on Ovarian Cancer Cells," Drug Delivery, Nov. 2008, 15(8), 523-529.

Tachibana et al., "An assessment of relative transcriptional availability from nonviral vectors," International Journal of Pharmaceutics, Feb. 11, 2004, 270(1-2), 315-321.

Tachibana et al., "Effect of cationic liposomes in an in vitro transcription and translation system," Biological & Pharmaceutical Bulletin, Apr. 2002, 25(4), 529-531.

Tagami et al., "Effect of siRNA in PEG-coated siRNA-lipoplex on anti-PEG IgM production," Journal of Controlled Release, Aug. 4, 2009, 137(3), 234-240.

Umebayashi et al., "Inhibitory effects of three-component hybrid liposomes containing cationic lipids without drugs on the growth of human renal tumor cells in vitro," Biological & Pharmaceutical Bulletin, Sep. 2008, 31(9), 1816-1817.

Hada et al., "The first synthesis of PEG—carotenoid conjugates," Chemical Abstracts Services, XP002690323, Apr. 2011, 8 pages.

International Patent Application No. PCT/US2012/041753: International Search Report dated Jan. 30, 2013, 8 pages.

Li et al., "Synthesis of polyethylene glycol (PEG) derivatives and PEGylated-peptide biopolymer conjugates," Biomacromolecules, Jul.-Aug. 2003, 4(4), 1055-1067.

Moon et al., "Regulation of adipocyte differentiation by PEGylated all-trans retinoic acid: reduced cytotoxicity and attenuated lipid accumulation," J. Nutr. Biochemistry, May 2007, 18(5), 322-331.

Schreiber et al., "Disperse multiphase systems linked by covalent bonds into a network," Chemical Abstracts Services, XP002690325, 1999, 1 page.

Bentley et al.; "Water-soluble polymer conjugates of retinoic acid"; XP002690324; Database Accession No. 2003:356296; CAPLUS ©2016; 5 pages.

Diec et al.; "Cosmetic or dermatological crosslinked microemulsions"; XP002690326; Database Accession No. 1998:239092; CAPLUS ©2016; 4 pages.

Schreiber et al.; "Crosslinked structures with double lipid membranes or based on peptides"; XP002690327; Database Accession No. 1998:208404; CAPLUS ©2016; 6 pages.

Niitsu et al.; "Retinoid-Liposomes for enhancing modulation of human hsp47 expression for treatment of fibrosis"; XP002690328; Database Accession No. 2012:1819002; CAPLUS ©2016; 14 pages.

European Patent Application No. 15181729.3; Extended Search Report; dated Feb. 18, 2016; 12 pages.

Hada et al.; "The first synthesis of PEG-carotenoid conjugates"; Tetrahedron Letters; vol. 52; 2011; p. 3195-3197.

Horimoto et al.; "Liquid Crystal Compostions"; XP002684897; Database Accession No. 1987:11469; CAPLUS; accessed 2012; one page.

Tagami et al.; "Effect of siRNA in PEG-coated siRNA—lipoplex on anti-PEG IgM productions"; XP002684899; Database Accession No. 2009:776119; CAPLUS; accessed 2012; one page.

Nakashima et al., "Design of a Lipid Bilayer Electrical Device. Strong Chemical Structure Dependence and Molecular Mechanisms on the Phase Transition-Dependent Electrical Impedance Responses of the Device in Air," J. Phys. Chem. B, May 1998, 102(22), 4440 (Additions/Corrections).

Ogris et al., "DNA/polyethylenimine transfection particles: Influence of ligands, polymer size, and PEGylation on internalization and gene expression," AAPS PharmSci, Sep. 2001, 3(3), 43-53.

(56) References Cited

OTHER PUBLICATIONS

Radwan et al., "Cationic liposome-mediated gene delivery: Biophysical study and mechanism of internalization," Archives of Biochem. And Biophysics, Feb. 2003, 410(2), 246-253.
Solodin et al., "Synthesis of Novel Cationic Lipids with a Guanidine Group. Cationic Lipids, 3.sup.1," Synlett, Jul. 1996, 7, 617-618.
China Patent Application No. 201280027912.7; Office Action; dated Nov. 15, 2014; 11 pages.
Russia Patent Application No. 2013158456/04; Office Action; dated Apr. 22, 2016; 10 pages.
Australia Patent Application No. 2012267467; Office Action; dated Jul. 11, 2016; 3 pages.
Dunham et al.; "Membrane fusion: Studies with a calcium-sensitive dye, arsenazo III, in liposomes"; Proc. Natl. Acad. Sci. USA—Cell Biology; vol. 74 No. 4; Apr. 1977; p. 1580-1584.
Fallowfield et al.; "Targeted treatment for cirrhosis"; Expert Opin Ther Targets; 8(5); 2004; p. 423-435.
Turner et al.; "Improved Parameters for Prediction of RNA Structure"; Cold Spring Harb Symp Quant. Biol.; 52; 1987; p. 123-133.
Frier et al.; "Improved free-energy parameters for predictions of RNA duplex stability"; Proc. Nat. Acad. Sci. USA; vol. 83; Dec. 1986; p. 9373-9377.
Turner et al.; "Free Energy Increments for Hydrogen Bonds in Nucleic Acid Base Pairs"; J. Am. Chem. Soc.; 109; 1987; p. 3783-3785.
"Biochemical Nomenclature and Related Documents"; 2nd Edition Portland Press; p. 247-251; 1992.
Bernstein et al.; "Role for a bidentate ribonuclease in the initiation step of RNA interference"; Nature; vol. 409; Jan. 2001; p. 363-366.
Allart et al.; "1,5-Anhydro-2-Deoxy-D-Altritol Oligonucleotides as Conformationally Restricted Analogues of RNA"; Nucleosides & Nucleotides; 17; 1998; p. 1523-1526.
Perez-Perez et al.; "Synthesis and Antiviral Activity of 2-Deoxy-1-5-Anhydro-D-Mannitol Nucleosides Containing A Pyrimidine Base Moiety"; Biorg. And Medicinal Chem Letters; vol. 6 No. 13; 1996; p. 1457-1460.
Brody et al; "Aptamers as therapeutic and diagnostic agents"; Review in Molecular Biotechnology; vol. 74; 2000; p. 5-13.
Sun; "Technology evaluation: SELEX Gilead Sciences Inc."; Curr. Opin. Mol. Ther.; vol. 2 No. 1; 2000; p. 100-105.
Kusser; "Chemically modified nucleic acid aptamers for in vitro selections: evolving evolution"; Reviews in Molecular Biotechnology; vol. 74; 2000; p. 27-38.
Richardson et al.; "Tethered Oligonucleotide Probes. A Strategy for the Recognition of Structured RNA"; J. Am. Chem. Soc.; 113; 1991; p. 5109-5111.
Ma et al.; "Design and Synthesis of RNA Miniduplexes via a Synthetic Linker Approach"; Biochemistry; vol. 32 No. 7; Nov. 1993; p. 1751-1758.
McCurdy et al.; "Deoxyoligonucleotides with inverted polarity: synthesis and use in triple-helix formation"; Nucleosides & Nucleotides; vol. 10; 1991 p. 287-290.
Jaschke et al.; "Automated Incorporation of Polyethylene Glycol into Synthetic Oligonucleotides"; Tetrahedron Lett.; vol. 34 No. 2; 1993; p. 301-304.
Ferentz et al.; "Disulfide Cross-Linked Oligonucleotides"; J. Am. Chem. Soc.; vol. 113; 1991; p. 4000-4002.
Nagata; "Hsp47: a collagen-specific molecular chaperone"; Trends Biochem Sci; TIBS 21; 1996; 4 pages.
Razzaque et al.; "Heat Shock Protein 47 and Renal Fibrogenesis"; Contrib Nephrol; vol. 148; 2005; p. 57-69.
Leivo et al.; "Appearance and Distribution of Collagens and Laminin in the Early Mouse Embryo"; Dev. Biol.; vol. 76; 1980; p. 100-114.
Razzaque et al.; "Bleomycin-induced pulmonary fibrosis in rat is associated with increased expression of collagen-binding heat shock protein (HSP) 47"; Virchows Arch; vol. 432; 1998; p. 455-460.
Chen et al.; "Effect of heat shock protein 47 on collagen accumulation in keloid fibroblast cells"; Br J. Dermatol; vol. 156; 2007; p. 1188-1195.

Bergeron et al.; "Calnexin: a membrane-bound chaperone of the endoplasmic reticulum"; Trends Biochem. Sci.; TIBS 19; Mar. 1994; p. 124-128.
Herbert et al.; "Calnexin, Calreticulin, and Bip/Kar2p in Protein Folding"; Cold Spring Harb. Symp. Quant. Biol.; vol. 60; 1995; p. 405-415.
Molina et al.; "Fibrotic Diseases"; Harefuah; vol. 141; 2002; p. 1009.
Yu et al.; "Therapeutic strategies to halt renal fibrosis"; Curr Opin Pharmacol.; 2(2); 2002; p. 177-181.
Keane et al.; "Recent Advances in Management of Type 2 Diabetes and Nephropathy: Lessons From the RENAAL Study"; Am J. Kidney Dis; vol. 41 No. 3; Mar. 2003; p. S22-S25.
Bohle et al.; "The Pathogenesis of Chronic Renal Failure"; Pathol. Res. Pract.; vol. 185; 1989; p. 421-440.
Kikkawa et al.; "Mechanism of the progression of diabetic nephropathy to renal failure"; Kidney Int. Supply; vol. 62; 1997; p. S39-40.
Bataller et al.; "Hepatic Stellate Cells as a Target for the Treatment of Liver Fibrosis"; Semin Liver Dis.; vol. 21 No. 3; 2001; p. 437-451.
Frohlich; "Fibrosis and Ischemia: The Real Risks in Hypertensive Heart Disease"; Am J. Hypertens; vol. 14 No. 6; Jun. 2001; p. 194S-199S.
Weber; "Fibrosis and hypertensive heart disease"; Current Opinion in Cardiology; 2000; vol. 15; p. 264-272.
Broaddus et al.; Distribution and Stability of Antisense Phosphorothioate Oligonucleotides in Rodent Brain Following Direct Intraparenchymal Controlled-Rate Infusion; J. Neurosurg; vol. 88 No. 4; Apr. 1998; p. 734-742 (abstract only).
Karle et al.; "Differential changes in induced seizures after hippocampal treatment of rats with an antisense oligodeoxynucleotide to the GABA receptor y2 subunit"; Eur. J. of Pharmacol.; vol. 340; 1997; p. 153-160.
Bannai et al.; "Effect of injection of antisense oligodeoxynucleotides of GAD isozymes into rat ventromedial hypothalamus on food intake and locomotor activity"; Brain Research; vol. 784; 1998; p. 305-315.
Rajakumar et al.; "Effects of Intrastriatal Infusion of D2 Receptor Antisense Oligonucleotide on Apomorphine-Induced Behaviors in the Rat"; Synapse; vol. 26; 1997; p. 199-208.
Wu-Pong et al.; "Nucleic Acid Drug Delivery, Part 2—Delivery to the Brain"; BioPharm; Jan. 1999; p. 32-39.
Bannai et al.; "Water-absorbent polymer as a carrier for a discrete deposit of antisense oligodeoxynucleotides in the central nervous system"; Brain Res. Protoc.; vol. 3; 1998; p. 83-87.
Furgeson et al.; "Modified Linear Polyethyleniamine-Cholesterol Conjugates for DNA Complexation"; Bioconjugate Chem.; vol. 14; 2003; p. 840-847.
Kunath et al.; The Structure of PEG-Modified Poly(Ethylene Imines) Influences Biodistribution and Pharmacokinetics of Their Complexes with NF-kB Decoy in Mice; Pharm Res.; vol. 19 No. 6; Jun. 2002; p. 810-817.
Bettinger et al.; "Size Reduction of Galactosylated PEI/DNA Complexes Improves Lectin-Mediated Gene Transfer into Hepatocytes"; Bioconjugate Chem.; vol. 10; p. 1999; p. 558-561.
Peterson et al.; "Polyethylenimine-graft-Poly(ethylene glycol) Copolymers: Influence of Copolymer Block Structure on DNA Complexation and Biological Activities as Gene Delivery System"; Bioconjugate Chem.; vol. 13; 2002; p. 845-854.
Miyagishi et al.; "U6 promoter-driven si RNAs with four uridine 3'overhangs efficiently suppress targeted gene expression in mammalian cells"; Nature Biotech; vol. 19; May 2002; p. 497-550.
Lee et al.; "Expression of small interfering RNAs targeted against HIV-1 rev transcripts in human cells"; Nature Biotech; vol. 19; May 2002; p. 500-505.
Novina et al., "siRNA-Directed Inhibition of HIV-1 Infection", Nature Medicine; vol. 8 No. 7; Jul. 2002; p. 681-686.
Paul et al., "Effective Expression of Small Interfering RNA in Human Cells", Nature Biotech.; vol. 29; May 2002; p. 505-508.
Lieber et al.; "Stable High-Level Gene Expression in Mammalian Cells by T7 Phage RNA Polymerase"; Methods in Enzymol; vol. 217; 1993; p. 47-66.

(56) References Cited

OTHER PUBLICATIONS

Kashani-Sabet et al.; "Reversal of the Malignant Phenotype by an Anti-ras Ribozyme"; Antisense Res. And Dev.; vol. 2; 1992 p. 3-15.
L'Huillier et al., "Cytoplasmic Delivery of Ribozymes Leads to Efficient Reduction in Alpha-lactalbumin mRNA Levels in C1271 Mouse Cells"; The EMBO Journal; vol. 11 No. 12; 1992; p. 4411-4418.
Sullenger et al.; Tethering Ribozymes to a Retroviral Packaging Signal for Destruction of Viral RNA; Science; vol. 262; Dec. 1993; p. 1566-1569.
Izant et al.; "Constitutive and Conditional Suppression of Exogenous and Endogenous Genes by Anti-Sense RNA"; Science; vol. 229; 1985; p. 345-352.
Sarver et al.; "Ribozymes as Potential Anti-HIV-1 Therapeutic Agents"; Science; vol. 247; 1990; p. 1222-1225.
Ohkawa et al.; "Activities of HIV-RNA targeted ribozymes transcribed from a 'shot-gun' type ribozyme-trimming plasmid"; 19th Nucleic Acids Symp. Ser.; vol. 27; Nov. 1992; p. 15-16.
Peterkofsky et al.; "Use of a Mixture of Proteinase-Free Collagenases for the Specific Assay of Radioactive Collagen in the Presence of Other Proteins"; Biochemistry; vol. 10 No. 6; 1971; p. 988-994.
Jezequel et al.; "A morphological study of the early stages of hepatic fibrosis induced by low doses of dimethylnitrosamine in the rat"; J. of Hepatol.; vol. 5; 1987; p. 174-181.
McCaffery et al.; "RNA interference in adult mice"; Nature; vol. 418; Jul. 2002; p. 38-39.
Ueki et al.; "Hepatocyte growth factor gene therapy of liver cirrhosis in rats"; Nat Med.; vol. 5 No. 2; Feb. 1999; p. 226-230.
Lotersztajn et al.; "Hepatic Fibrosis: Molecular Mechanisms and Drug Targets"; Annual Rev Pharmacol Toxicol.; vol. 45; Oct. 2004; p. 605-628.
Uchio et al.; "Down-regulation of connective tissue growth factor and type I collagen mRNA expression by connective tissue growth factor antisense oligonucleotide during experimental liver fibrosis"; Wound Repair Regen; 12(1); Feb. 2004; p. 60-66.
Sherwood et al.; "A New Model of Glaucoma Filtering Surgery in the Rat"; J. Glaucoma; 13(5); Oct. 2004; 407-412.
Miller et al.; "Wound Healing in an Animal Model of Glaucoma Fistulizing Surgery in the Rabbit"; Ophthalmic Surg.; 20(5); May 1989; p. 350-357.
vanBockxmeer et al.; "Models for Assessing Scar Tissue Inhibitors"; Retina; vol. 5 No. 1; 1985; p. 47-60.
Wiedemann et al.; "Proliferative Vitreoretinopathy: The Rabbit Cell Injection Model for Screening of Antiproliferative Drugs"; J. Pharmacol Methods; vol. 12; 1984; p. 69-78.
Wang et al.; "Bioavailability and anticataract effects of a topical ocular drug delivery system containing disulfiram and hydroxypropyl-beta-cyclodextrin on selenite-treated rats"; Curr Eye Res.; vol. 29; 2004; p. 51-58.
Mizobuchi et al.; "Comparison of Surgical Procedures for Vascular and Airway Anastomoses That Utilize a "Modified" Non-Suture External Cuff Technique for Experimental Lung Transplantation in Rats"; The J. Heart Lung Transplantation; vol. 23; 2004; p. 889-893.
Onuma et al.; "Correlation between the Airway Branching Patterns and the Heterogeneous Distribution of the Lesions in Bleomycin-Injured Mouse Lung: a 3-D Morphometric Study"; J. Exp. Med; vol. 194; 2001; p. 147-156.
Yamaguchi et al.; "Expression of human proteoglycan in Chinese hamster ovary cells inhibits cell proliferation"; Nature; vol. 336; Nov. 1988; p. 244-246.
European Patent Application No. 15181729.3; Office Action—Article 94(3); dated Nov. 7, 2016; 6 pages.
Taiwan Patent Application No. 101120615; Office Action; dated Feb. 9, 2017; 7 pages.
Japan Patent Application No. 2016-006249; Office Action—Reason for Refusal; dated Nov. 17, 2016; 13 pages (contains English Translation).
Pedersen et al.; "Liposomal Formulation of Retinoids Designed for Enzyme Triggered Release"; Journal of Medicinal Chemistry; vol. 53 No. 9; 2010; p. 3782-3792.
Chiu et al.; "siRNA function in RNAi: A chemical modification analysis"; RNA; vol. 9 No. 9; 2003; p. 1034-1048.
Korean Patent Application No. 10-2014-7000572; Notice of Preliminary Rejection; dated Jul. 11, 2018; 17 pages.
Australian Patent Application No. 2017203075; Examination Report; dated Jun. 19, 2018; 4 pages.
Japan Patent Application No. 2017-203199; Reasons for Refusal; dated Oct. 19, 2018; 8 pages.
China Patent Application No. 201710081577.3; Office Action; dated Aug. 28, 2018; 13 pages.

\* cited by examiner

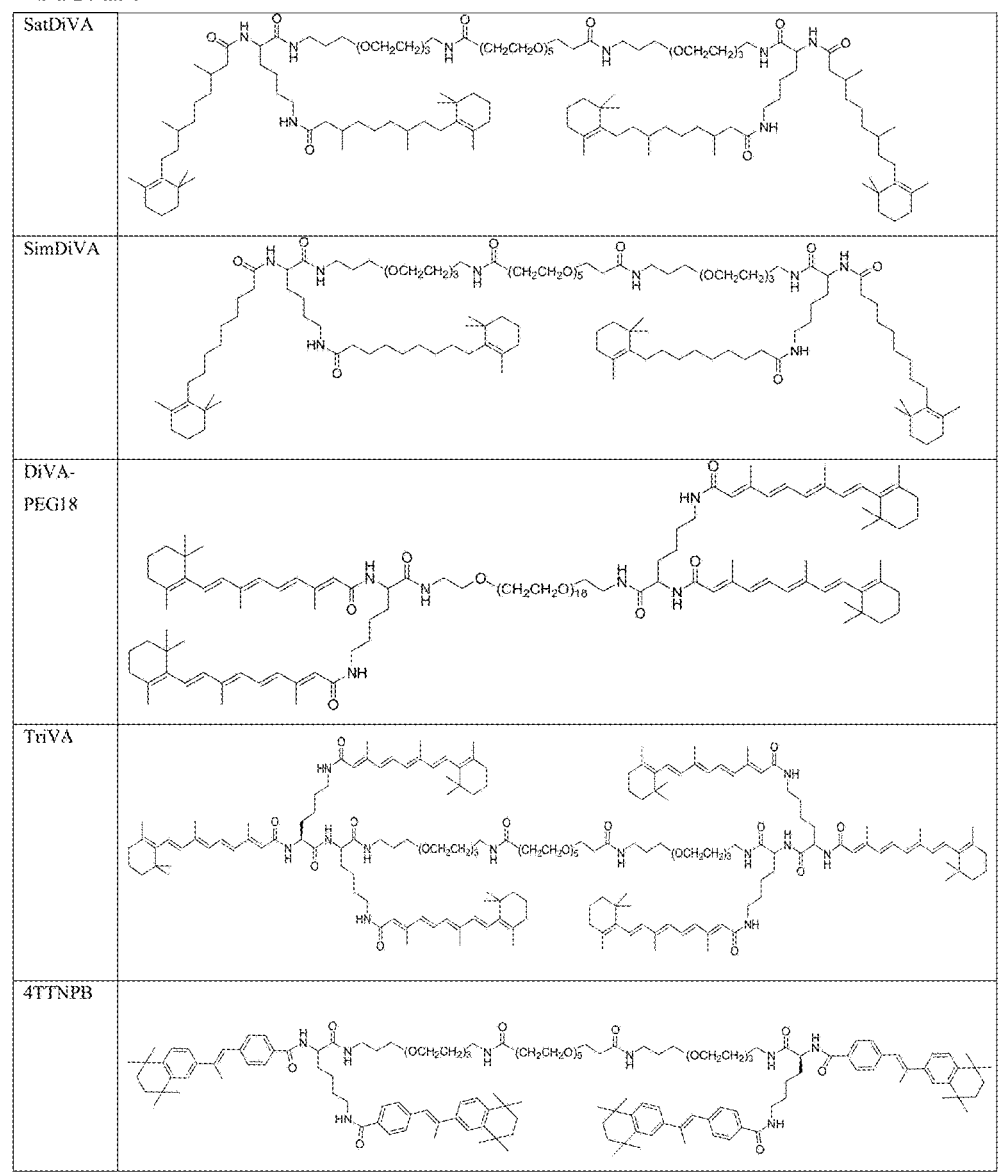

Treatment:
1. cells only
2. RNAiMAX
3. RNAiMAX + scrambled siRNA
4. RNAiMAX + siGFP

RETINOID-LIPID DRUG CARRIER

CROSS REFERENCE TO RELATED APPLICATIONS

This application is a continuation-in-part of U.S. patent application Ser. No. 14/294,021, filed Jun. 2, 2014, now U.S. Pat. No. 9,456,984 issued on Oct. 4, 2016, which is a continuation of U.S. patent application Ser. No. 13/492,594 filed on Jun. 8, 2012, now U.S. Pat. No. 8,741,867 issued on Jun. 3, 2014, which claims benefit under 35 U.S.C. § 119(e) of provisional U.S. patent application No. 61/494,832 filed on Jun. 8, 2011; and a continuation-in-part of U.S. patent application Ser. No. 15/177,284, filed Jun. 8, 2016, which is a continuation of patent application Ser. No. 13/492,424 filed on Jun. 8, 2012, now U.S. Pat. No. 9,393,315 issued on Jul. 19, 2016, which claims the benefit of U.S. provisional application No. 61/494,840 filed Jun. 8, 2011; and a continuation-in-part of U.S. application Ser. No. 15/005,569, filed Jan. 25, 2016, which is a continuation of U.S. patent application Ser. No. 14/256,306, filed Apr. 18, 2014, now U.S. Pat. No. 9,242,001 issued on Jan. 26, 2016, which is a divisional of U.S. patent application Ser. No. 13/492,650, filed Jun. 8, 2012, now U.S. Pat. No. 9,011,903 issued on Apr. 21, 2015, which claims the benefit of U.S. provisional application No. 61/494,710, filed Jun. 8, 2011, the entire contents of which are incorporated herein by reference in their entirety.

TECHNICAL FIELD

Provided herein are pharmaceutical compositions comprising liposomes for enhancing the modulation of hsp47 expression by siRNA, wherein the liposomes comprise fat-soluble vitamin compounds and cationic lipids to target and enhance activity of the siRNA.

BACKGROUND

Fibrosis of the liver can be caused by activated hepatic stellate cells (HSC), resulting in a plurality of types of collagen molecules and fibronectin being deposited on interstitial tissue. This can lead to hepatic cirrhosis, hepatic failure, and/or hepatocellular carcinoma. Chronic pancreatitis develops as a result of pancreatic fibrosis by the same mechanism as that for hepatic fibrosis (Madro, et al., 2004; Med Sci Monit. 10:RA166-70.; Jaster, 2004, Mol Cancer. 6:26). Stellate cells are present in disorders of the vocal cord and larynx such as vocal cord scarring, vocal cord mucosal fibrosis, and laryngeal fibrosis. To prevent or treat fibrosis in these organs and elsewhere in the body, there is a desire for the development of a drug carrier and drug carrier kit.

Stellate cells are one of the important target candidates for treating fibrosis (Fallowfield et al., 2004, Expert Opin Ther Targets. 8:423-35; Pinzani, et al., 2004, Dig Liver Dis. 36:231-42). During fibrosis, stellate cells are activated by cytokines from nearby cells to produce many factors that cause hepatic fibrosis. Stellate cells store vitamin A, and belong to the myofibroblast family.

Therapeutic methods to prevent or treat fibrosis attempt to control collagen metabolism, promotion of the collagen degradation system, and inhibition of activation of stellate cells. However, in all these cases, the low specificity of action and/or the low organ specificity, limited efficacy and adverse side effects create problems.

Inhibition of collagen protein synthesis has not been established as a therapeutic method. The potency of molecules targeting collagen production is limited due to the possibility of causing side effects. Inhibiting collagen production directly provides another therapeutic method to prevent or treat fibrosis. Such a method requires controlling one or more of the various types of collagen Types I to IV. A method for accomplishing this may be through heat shock protein47 (HSP47), a collagen-specific molecular chaperone that is essential for intracellular transport and molecular maturation necessary for various types of collagen. Therefore, if the function of HSP47 can be specifically controlled in stellate cells, there is a possibility of inhibiting hepatic fibrosis.

SUMMARY

What is described is a pharmaceutical composition comprising a drug carrier and a double-stranded nucleic acid molecule, wherein the drug carrier comprises a liposome and a stellate cell-specific amount of a compound for facilitating drug delivery to a target cell, consisting of the structure (targeting molecule)$_m$-linker-(targeting molecule)$_n$, wherein the targeting molecule is a retinoid or a fat soluble vitamin having a specific receptor on the target cell, and wherein m and n are independently 0, 1, 2, or 3; and wherein the double-stranded nucleic acid molecule comprises the structure (A2) set forth below:

5' N1-(N)x-Z 3'(antisense strand)

3'Z'—N2-(N')y-z"5'(sense strand)      (A2)

wherein each of N2, N and N' is an unmodified or modified ribonucleotide, or an unconventional moiety; wherein each of (N)x and (N')y is an oligonucleotide in which each consecutive N or N' is joined to the adjacent N or N' by a covalent bond; wherein each of x and y is independently an integer between 17 and 39; wherein the sequence of (N')y has complementarity to the sequence of (N)x and (N)x has complementarity to a consecutive sequence in a target RNA; wherein N1 is covalently bound to (N)x and is mismatched to the target RNA or is a complementary DNA moiety to the target RNA; wherein N1 is a moiety selected from the group consisting of natural or modified uridine, deoxyribouridine, ibothymidine, deoxyribothymidine, adenosine or deoxyadenosine; wherein z" may be present or absent, but if present is a capping moiety covalently attached at the 5'-terminus of N2-(N')y; wherein each of Z and Z' is independently present or absent, but if present is independently 1-5 consecutive nucleotides, consecutive non-nucleotide moieties or a combination thereof covalently attached at the 3'-terminus of the strand in which it is present; and wherein (N)x comprises an antisense sequence to the mRNA coding sequence for human hsp47 exemplified by SEQ ID NO:1.

One embodiment, the retinoid is selected from the group consisting of vitamin A, retinoic acid, tretinoin, adapalene, 4-hydroxy(phenyl)retinamide (4-HPR), retinyl palmitate, retinal, saturated retinoic acid, and saturated, demethylated retinoic acid.

In another embodiment, the linker is selected from the group consisting of bis-amido-PEG, tris-amido-PEG, tetra-amido-PEG, Lys-bis-amido-PEG Lys, Lys-tris-amido-PEG-Lys, Lys-tetr-amido-PEG-Lys, Lys-PEG-Lys, PEG2000, PEG1250, PEG1000, PEG750, PEG550, PEG-Glu, Glu, C6, Gly3, and GluNH.

In another embodiment, the compound is selected from the group consisting of retinoid-PEG-retinoid, (retinoid)$_2$-PEG-(retinoid)$_2$, VA-PEG2000-VA, (retinoid)$_2$-bis-amido-PEG-(retinoid)$_2$, (retinoid)$_2$-Lys-bis-amido-PEG-Lys-(retinoid)$_2$.

In another embodiment, the retinoid is selected from the group consisting of vitamin A, retinoic acid, tretinoin, adapalene, 4-hydroxy(phenyl)retinamide (4-HPR), retinyl palmitate, retinal, saturated retinoic acid, and saturated, demethylated retinoic acid.

In another embodiment, the compound is a composition of the formula

In another embodiment, the linker is selected from the group consisting of bis-amido-PEG, tris-amido-PEG, tetra-amido-PEG, Lys-bis-amido-PEG Lys, Lys-tris-amido-PEG-Lys, Lys-tetr-amido-PEG-Lys, Lys-PEG-Lys, PEG2000, PEG1250, PEG1000, PEG750, PEG550, PEG-Glu, Glu, C6, Gly3, and GluNH.

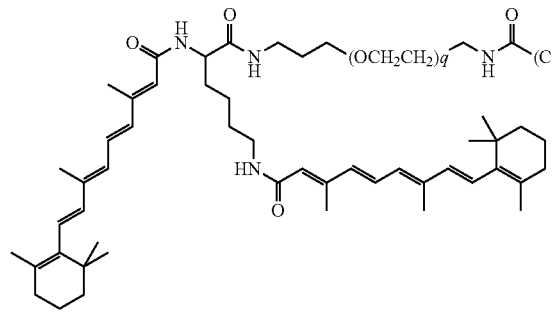
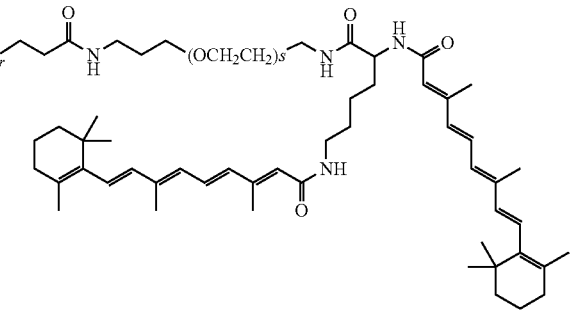

wherein q, r, and s are each independently 1, 2, 3, 4, 5, 6, 7, 8, 9, or 10.

In another embodiment, the formula of the compound comprises the one shown in FIG. 34A.

In another aspect, the present description provides a stellate-cell-specific drug carrier comprising a stellate cell specific amount of a retinoid molecule consisting of the structure (retinoid)$_m$-linker-(retinoid)$_n$; wherein m and n are independently 0, 1, 2 or 3; and wherein the linker comprises a polyethylene glycol (PEG) or PEG-like molecule.

In another embodiment, the present description provides a composition comprising a liposomal composition. In other embodiments, the liposomal composition comprises a lipid vesicle comprising a bilayer of lipid molecules.

In certain embodiments, the retinoid molecule is at least partially exposed on the exterior of the drug carrier before the drug carrier reaches the stellate cell.

In another embodiment, the retinoid is 0.1 mol % to 20 mol % of the lipid molecules. The retinoid will be present in a concentration of about 0.3 to 30 weight percent, based on the total weight of the composition or formulation, which is equivalent to about 0.1 to about 10 mol %.

In another embodiment, the lipid molecules further comprise S104.

In certain embodiments, the drug carrier comprises a nucleic acid.

In other embodiments, the nucleic acid is an siRNA that is capable of knocking down expression of hsp47 mRNA in the stellate cell.

In another aspect, the present description provides a compound for facilitating drug delivery to a target cell, consisting of the structure (lipid)$_m$-linker-(targeting molecule)$_n$, wherein the targeting molecule is a retinoid or a fat soluble vitamin having a specific receptor or activation/binding site on the target cell; wherein m and n are independently 0, 1, 2 or 3; and wherein the linker comprises a polyethylene glycol (PEG) molecule.

In another embodiment, the retinoid is selected from the group consisting of vitamin A, retinoic acid, tretinoin, adapalene, 4-hydroxy(phenyl)retinamide (4-HPR), retinyl palmitate, retinal, saturated retinoic acid, and saturated, demethylated retinoic acid.

In another embodiment of the present description, the fat-soluble vitamin is vitamin D, vitamin E, or vitamin K.

In another embodiment the present invention is selected from the group consisting of DSPE-PEG-VA, DSPE-PEG2000-Glu-VA, DSPE-PEG550-VA, DOPE-VA, DOPE-Glu-VA, DOPE-Glu-NH-VA, DOPE-Gly3-VA, DC-VA, DC-6-VA, and AR-6-VA.

Another aspect of the description is a pharmaceutical composition comprising a drug carrier and a double-stranded nucleic acid molecule, wherein the drug carrier comprises a liposome and a stellate cell-specific amount of a compound for facilitating drug delivery to a target cell, wherein the liposome comprises a lipid of formula I

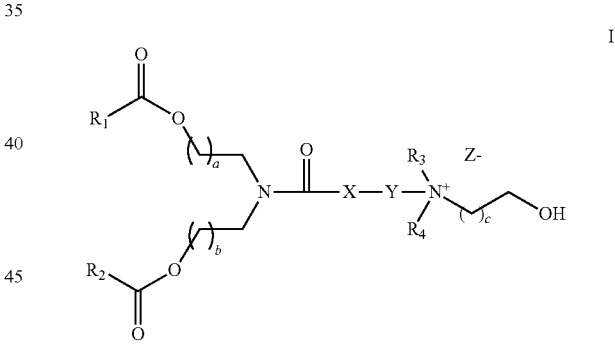

wherein $R_1$ and $R_2$ is independently selected from a group consisting of $C_{10}$ to $C_{18}$ alkyl, $C_{12}$ to $C_{18}$ alkenyl, and oleyl group; wherein $R_3$ and $R_4$ are independently selected from a group consisting of $C_1$ to $C_6$ alkyl, and $C_2$ to $C_6$ alkanol; wherein X is selected from a group consisting of —CH$_2$—, —S—, and —O— or absent; wherein Y is selected from —(CH$_2$)$_n$—, —S(CH$_2$)$_n$, —O(CH$_2$)$_n$—, thiophene, —SO$_2$(CH$_2$)$_n$—, and ester, wherein n=1-4; wherein a=1-4; wherein b=1-4; wherein c=1-4; and wherein Z is a counterion; and wherein the double-stranded nucleic acid molecule comprises the structure (A2) set forth above.

In another aspect of the description, the lipid is selected from the group consisting of the lipids shown in FIGS. 1A and 1B.

BRIEF DESCRIPTION OF THE DRAWINGS

FIG. 2A and FIG. 2B show exemplary retinoid conjugates described herein.

FIG. 9A shows preparation of HEDC-BOC-IN.
FIG. 9C shows preparation of HEDC-DiMeGly-IN.

FIG. 34B shows preparation of Z-DiVA-PEG-DiVA-IN.

FIG. 34C shows preparation of DiVA-PEG-DiVA-IN.

DETAILED DESCRIPTION OF ILLUSTRATIVE EMBODIMENTS

Definitions

Figure 1A:
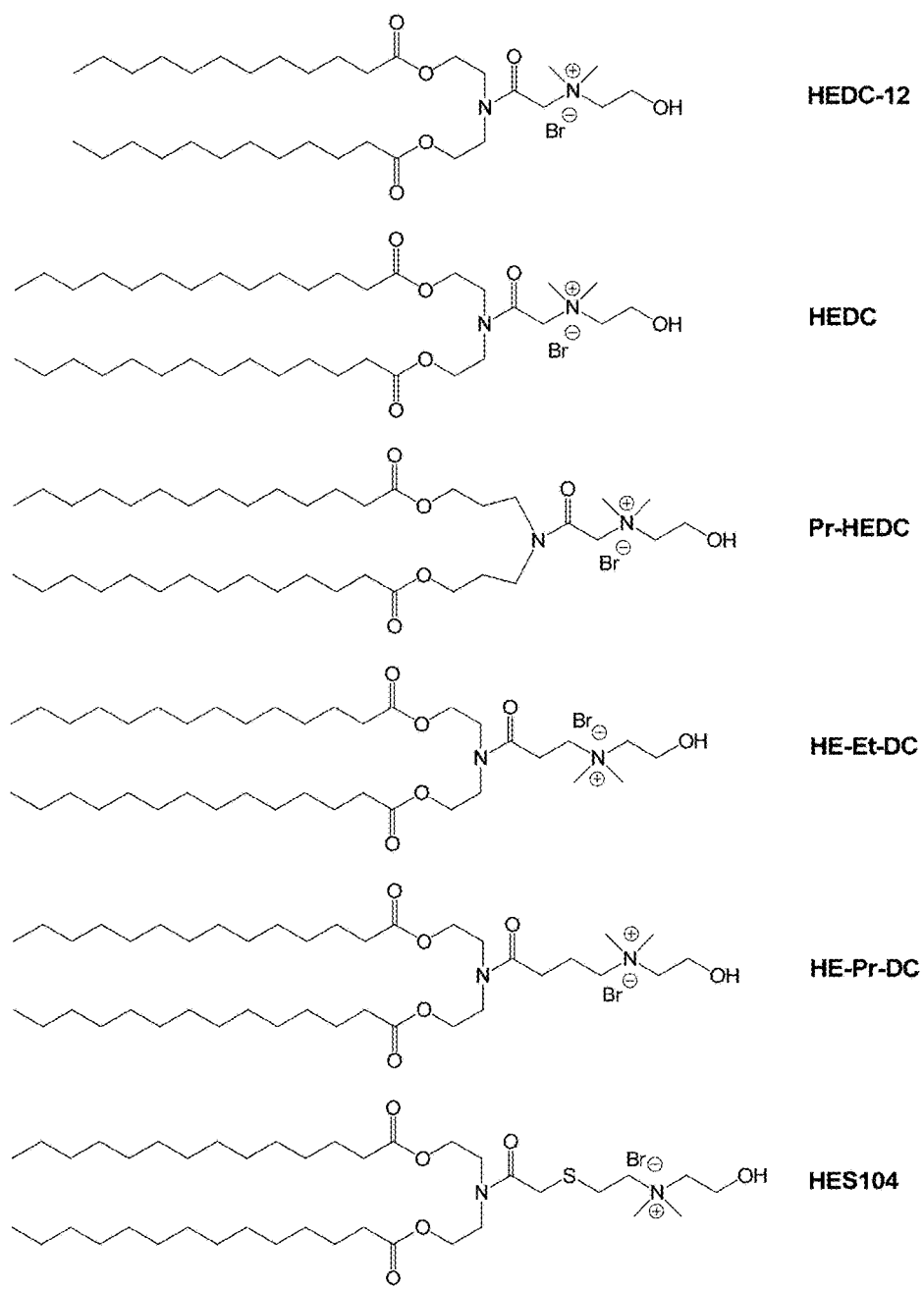
FIG. 1A and FIG. 1B show exemplary compounds of formula I.

As used herein, the term "heat shock protein 47" or "hsp47" or "HSP47" are used interchangeably and refer to any heat shock protein 47, peptide, or polypeptide having any hsp47 protein activity. Heat shock protein 47 is a serine proteinase inhibitor (serpin) also known, for example, as serpin peptidase inhibitor, clade H, member 1 (SERPINH1), SERPINH2, collagen binding protein 1 (CBP1), CBP2, gp46; arsenic-transactivated protein 3 (AsTP3); HSP47; proliferation-inducing gene 14 (PIG14); PPROM; rheumatoid arthritis antigen A-47 (RA-A47); colligin-1; and colligin-2. In certain preferred embodiments, "hsp47" refers to human hsp47. Heat shock protein 47 (or more particularly human hsp47) may have an amino acid sequence that is the same, or substantially the same, as SEQ ID NO. 2.

As used herein the term "nucleotide sequence encoding hsp47" means a nucleotide sequence that codes for an hsp47 protein, or portion thereof. The term "nucleotide sequence encoding hsp47" is also meant to include hsp47 coding sequences such as hsp47 isoforms, mutant hsp47 genes, splice variants of hsp47 genes, and hsp47 gene polymorphisms. A nucleic acid sequence encoding hsp47 includes mRNA sequences encoding hsp47, which can also be referred to as "hsp47 mRNA." An exemplary sequence of human hsp47 mRNA is SEQ ID. NO. 1.

As used herein, the term "nucleic acid molecule" or "nucleic acid" are used interchangeably and refer to an oligonucleotide, nucleotide or polynucleotide. Variations of "nucleic acid molecule" are described in more detail herein. A nucleic acid molecule encompasses both modified nucleic acid molecules and unmodified nucleic acid molecules as described herein. A nucleic acid molecule may include deoxyribonucleotides, ribonucleotides, modified nucleotides or nucleotide analogs in any combination.

As used herein, the term "nucleotide" refers to a chemical moiety having a sugar (or an analog thereof, or a modified sugar), a nucleotide base (or an analog thereof, or a modified base), and a phosphate group (or analog thereof, or a modified phosphate group). A nucleotide encompasses modified nucleotides or unmodified nucleotides as described herein. As used herein, nucleotides may include deoxyribonucleotides (e.g., unmodified deoxyribonucleotides), ribonucleotides (e.g., unmodified ribonucleotides), and modified nucleotide analogs including, inter alia, LNA and UNA, peptide nucleic acids, L-nucleotides (also referred to as mirror nucleotides), ethylene-bridged nucleic acid (ENA), arabinoside, PACE, nucleotides with a 6 carbon sugar, as well as nucleotide analogs (including abasic nucleotides) often considered to be non-nucleotides. In some embodiments, nucleotides may be modified in the sugar, nucleotide base and/or in the phosphate group with any modification known in the art, such as modifications described herein. A "polynucleotide" or "oligonucleotide" as used herein, refers to a chain of linked nucleotides; polynucleotides and oligonucleotides may likewise have modifications in the nucleotide sugar, nucleotide bases and phosphate backbones as are well known in the art and/or are disclosed herein.

As used herein, the term "short interfering nucleic acid", "siNA", or "short interfering nucleic acid molecule" refers to any nucleic acid molecule capable of modulating gene expression or viral replication. Preferably siNA inhibits or down regulates gene expression or viral replication. siNA includes without limitation nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. As used herein, "short interfering nucleic acid", "siNA", or "short interfering nucleic acid molecule" has the meaning described in more detail elsewhere herein.

As used herein, the term "complementary" means that a nucleic acid can form hydrogen bond(s) with another nucleic acid sequence by either traditional Watson-Crick or other non-traditional types. In reference to the nucleic acid molecules disclosed herein, the binding free energy for a nucleic acid molecule with its complementary sequence is sufficient to allow the relevant function of the nucleic acid to proceed, e.g., RNAi activity. Determination of binding free energies for nucleic acid molecules is known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nt out of a total of 10 nt in the first oligonucleotide being based paired to a second nucleic acid sequence having 10 nt represents 50%, 60%, 70%, 80%, 90%, and 100% complementary respectively). "Fully complementary" means that all the contiguous residues of a nucleic acid sequence will hydrogen bond with the same number of contiguous residues in a second nucleic acid sequence. In one embodiment, a nucleic acid molecule disclosed herein includes about 15 to about 35 or more (e.g., about 15, 16, 17, 18, 19, 20, 21, 22, 23, 24, 25, 26, 27, 28, 29, 30, 31, 32, 33, 34 or 35 or more) nt that are complementary to one or more target nucleic acid molecules or a portion thereof.

As used herein, the term "sense region" refers to a nucleotide sequence of a siNA molecule complementary (partially or fully) to an antisense region of the siNA molecule. The sense strand of a siNA molecule can include a nucleic acid sequence having homology with a target nucleic acid sequence. As used herein, "sense strand" refers to nucleic acid molecule that includes a sense region and may also include additional nucleotides. Nucleotide positions of the sense strand are herein numbered 5'>3'.

As used herein, the term "antisense region" refers to a nucleotide sequence of a siNA molecule complementary (partially or fully) to a target nucleic acid sequence. The antisense strand of a siNA molecule can optionally include a nucleic acid sequence complementary to a sense region of the siNA molecule. As used herein, "antisense strand" refers to nucleic acid molecule that includes an antisense region and may also include additional nucleotides. Nucleotide positions of the antisense strand are herein numbered 5'>3'.

As used herein, the term "RNA" refers to a molecule that includes at least one ribonucleotide residue.

As used herein, the term "duplex region" refers to the region in two complementary or substantially complementary oligonucleotides that form base pairs with one another, either by Watson-Crick base pairing or any other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well known in the art. Alternatively, two strands can be synthesized and added together under biological conditions to determine if they anneal to one another.

As used herein, the terms "non-pairing nucleotide analog" means a nucleotide analog which includes a non-base pairing moiety including but not limited to: 6-des-amino adenosine (nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

As used herein, the term, "terminal functional group" includes without limitation a halogen, alcohol, amine, carboxylic, ester, amide, aldehyde, ketone, ether groups.

An "abasic nucleotide" or "abasic nucleotide analog" is as used herein may also be often referred to herein and in the art as a pseudo-nucleotide or an unconventional moiety. While a nucleotide is a monomeric unit of nucleic acid, generally consisting of a ribose or deoxyribose sugar, a phosphate, and a base (adenine, guanine, thymine, or cytosine in DNA; adenine, guanine, uracil, or cytosine in RNA), an abasic or pseudo-nucleotide lacks a base, and thus is not strictly a nucleotide as the term is generally used in the art. Abasic deoxyribose moieties include for example, abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moieties include inverted deoxyriboabasic; 3',5' inverted deoxyabasic 5'-phosphate.

The term "capping moiety" (z") as used herein includes a moiety which can be covalently linked to the 5'-terminus of $(N')_y$, and includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; $C_6$-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide;

5'-amino-alkyl phosphate; 1,3-diamino-2-propyl phosphate; 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non-bridging methylphosphonate and 5'-mercapto moieties.

Certain capping moieties may be abasic ribose or abasic deoxyribose moieties; inverted abasic ribose or abasic deoxyribose moieties; C6-amino-Pi; a mirror nucleotide including L-DNA and L-RNA. The nucleic acid molecules as disclosed herein may be synthesized using one or more inverted nucleotides, for example inverted thymidine or inverted adenine (for example see Takei, et al., 2002. JBC 277(26):23800-06).

The term "unconventional moiety" as used herein refers to non-nucleotide moieties including an abasic moiety, an inverted abasic moiety, a hydrocarbon (alkyl) moiety and derivatives thereof, and further includes a deoxyribonucleotide, a modified deoxyribonucleotide, a mirror nucleotide (L-DNA or L-RNA), a non-base pairing nucleotide analog and a nucleotide joined to an adjacent nucleotide by a 2'-5' internucleotide phosphate bond; bridged nucleic acids including LNA and ethylene bridged nucleic acids, linkage modified (e.g. PACE) and base modified nucleotides as well as additional moieties explicitly disclosed herein as unconventional moieties.

As used herein, the term "inhibit", "down-regulate", or "reduce" with respect to gene expression means the expression of the gene, or level of RNA molecules or equivalent RNA molecules encoding one or more proteins or protein subunits (e.g., mRNA), or activity of one or more proteins or protein subunits, is reduced below that observed in the absence of an inhibitory factor (such as a nucleic acid molecule, e.g., an siNA, for example having structural features as described herein); for example the expression may be reduced to 90%, 80%, 70%, 60%, 50%, 40%, 30%, 20%, 10%, 5% or less than that observed in the absence of an inhibitor.

As used herein, "alkyl" refers to a straight or branched fully saturated (no double or triple bonds) hydrocarbon, for example, having the general formula —$C_nH_{2n+1}$. The alkyl may have 1 to 50 carbon atoms (whenever it appears herein, a numerical range such as "1 to 50" refers to each integer in the given range; e.g., "1 to 50 carbon atoms" means that the alkyl may consist of 1 carbon atom, 2 carbon atoms, 3 carbon atoms, etc., up to and including 50 carbon atoms, although the present definition also covers the occurrence of the term "alkyl" where no numerical range is designated). The alkyl may also be a medium size alkyl having 1 to 30 carbon atoms. The alkyl could also be a lower alkyl having 1 to 5 carbon atoms. The alkyl of the compounds may be designated as "$C_1$-$C_4$ alkyl" or similar designations. By way of example only, "$C_1$-$C_4$ alkyl" indicates that there are one to four carbon atoms in the alkyl chain, i.e., the alkyl chain is selected from methyl, ethyl, propyl, iso-propyl, n-butyl, iso-butyl, sec-butyl, and t-butyl. Typical alkyls include, but are in no way limited to, methyl, ethyl, propyl, isopropyl, butyl, isobutyl, tertiary butyl, pentyl, hexyl and the like.

As used herein, "alkenyl" refers to an alkyl that contains in the straight or branched hydrocarbon chain one or more double bonds. An alkenyl may be unsubstituted or substituted. When substituted, the substituent(s) may be selected from the same structures disclosed above with regard to alkyl substitution unless otherwise indicated.

As used herein, "alkynyl" refers to an alkyl that contains in the straight or branched hydrocarbon chain one or more triple bonds. An alkynyl may be unsubstituted or substituted. When substituted, the substituent(s) may be selected from the same structures disclosed above with regard to alkyl substitution unless otherwise indicated.

As used herein, "halogen" refers to F, Cl, Br, and I.

As used herein, "mesylate" refers to —$SO_3CH_3$.

As used herein, the term "pharmaceutical formulation" refers to a mixture of a composition disclosed herein with one or more other chemical components, such as diluents or additional pharmaceutical carriers. The pharmaceutical formulation facilitates administration of the composition to an organism. Multiple techniques of administering a pharmaceutical formulation exist in the art including, but not limited to injection and parenteral administration.

As used herein, the term "pharmaceutical carrier" refers to a chemical compound that facilitates the incorporation of a compound into cells or tissues. For example dimethyl sulfoxide (DMSO) is a commonly utilized carrier as it facilitates the uptake of many organic compounds into the cells or tissues of an organism As used herein, the term "diluent" refers to chemical compounds diluted in water that will dissolve the formulation of interest (e.g., the formulation that can include a compound, a retinoid, a second lipid, a stabilizing agent, and/or a therapeutic agent) as well as stabilize the biologically active form of the formulation. Salts dissolved in buffered solutions are utilized as diluents in the art. One commonly used buffered solution is phosphate buffered saline because it mimics the salt conditions of human blood. Since buffer salts can control the pH of a solution at low concentrations, a buffered diluent rarely modifies the biological activity of the formulation. As used herein, an "excipient" refers to an inert substance that is added to a formulation to provide, without limitation, bulk, consistency, stability, binding ability, lubrication, disintegrating ability, etc., to the composition. A "diluent" is a type of excipient.

As used herein, "therapeutic agent" refers to a compound that, upon administration to a mammal in a therapeutically effective amount, provides a therapeutic benefit to the mammal. A therapeutic agent may be referred to herein as a drug. Those skilled in the art will appreciate that the term "therapeutic agent" is not limited to drugs that have received regulatory approval. A "therapeutic agent" can be operatively associated with a compound as described herein, a retinoid, and/or a second lipid. For example, a second lipid as described herein can form a liposome, and the therapeutic agent can be operatively associated with the liposome, e.g., as described herein.

As used herein, "lipoplex formulations" refer to those formulations wherein the siRNA is outside of the liposome. In preferred lipoplex formulations, the siRNA is complexed to the outside of the liposome. Other preferred lipoplex formulations include those wherein the siRNA is accessible to any medium present outside of the liposome.

As used herein, "liposome formulations" refer to those formulations wherein the siRNA is encapsulated within the liposome. In preferred liposome formulations, the siRNA is inaccessible to any medium present outside of the liposome.

As used herein, the term "co-solubilized" refers to the addition of a component to the cationic lipid mixture before addition of an aqueous medium and resulting formation of the vesicle.

As used herein, the term "decorated" refers to the addition of a component after vesicle formation in an aqueous solvent, in which the component is preferentially localized on the surface of the vesicle accessible to the aqueous medium outside of the vesicle.

As used herein, "DC-6-14" refers to O,O'-ditetradecanoyl-N-(alpha-trimethylammonioacetyl)diethanolamine chloride.

Figure 31A:
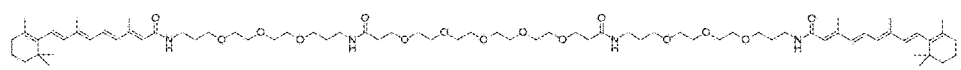
FIG. 31A shows the structure of VA-PEG-VA.

As used herein, "VA-PEG-VA" refers to the compound shown in FIG. 31A.

As used herein, a "retinoid" is a member of the class of compounds consisting of four isoprenoid units joined in a head-to-tail manner, and "vitamin A" is a retinoid exhibiting the biological activity of retinol (see G. P. Moss, "Biochemical Nomenclature and Related Documents," 2nd Ed. Portland Press, pp. 247-251 (1992)). As used herein, retinoid refers to natural and synthetic retinoids including first generation, second generation, and third generation retinoids. Examples of naturally occurring retinoids include, but are not limited to, (1) 11-cis-retinal, (2) all-trans retinol, (3) retinyl palmitate, (4) all-trans retinoic acid, and (5) 13-cis-retinoic acids. Furthermore, the term "retinoid" encompasses retinols, retinals, retinoic acids, retinoids, and derivatives thereof.

As used herein, "retinoid conjugate" refers to a molecule that includes at least one retinoid moiety.

As used herein, "retinoid-linker-lipid molecule" refers to a molecule that includes at least one retinoid moiety attached to at least one lipid moiety through at least one linker such as, for example, a PEG moiety.

As used herein, "retinoid-linker-retinoid molecule" refers to a molecule that includes at least one retinoid moiety attached to at least one other retinoid moiety (which may be the same or different) through at least one linker such as, for example, a PEG moiety.

As used herein, the terms "lipid" and "lipophilic" are used herein in their ordinary meanings as understood by those skilled in the art. Non-limiting examples of lipids and lipophilic structures include fatty acids, sterols, $C_2$-$C_{50}$ alkyl, $C_2$-$C_{50}$ heteroalkyl, $C_2$-$C_{50}$ alkenyl, $C_2$-$C_{50}$ heteroalkenyl, $C_5$-$C_{50}$ aryl, $C_5$-$C_{50}$ heteroaryl, $C_2$-$C_{50}$ alkynyl, $C_2$-$C_{50}$ heteroalkynyl, $C_2$-$C_{50}$ carboxyalkenyl, and $C_2$-$C_{50}$ carboxyheteroalkenyl. A fatty acid is a saturated or unsaturated long-chain monocarboxylic acid that contains, for example, 12 to 24 carbon atoms A lipid is characterized as being essentially water insoluble, having a solubility in water of less than about 0.01% (weight basis). As used herein, the terms "lipid moiety" and "lipophilic moiety" refers to a lipid or portion thereof that has become attached to another structure. For example, a lipid may become attached to another compound (e.g., a monomer) by a chemical reaction between a functional moiety (such as a carboxylic acid) of the lipid and an appropriate functional moiety of a monomer.

As used herein, "encapsulated by the liposome" refers to a component being substantially or entirely within the liposome structure.

As used herein, "accessible to the aqueous medium" refers to a component being able to be in contact with the aqueous medium.

As used herein, "inaccessible to the aqueous medium" refers to a component not being able to be in contact with the aqueous medium.

As used herein, "complexed on the outer surface of the liposome" refers to a component being operatively associated with the outer surface of the liposome in an aqueous solvent and accessible to aqueous medium outside of the liposome.

As used herein, "localized on the outer surface of the liposome" refers to a component being at or near the outer surface of the liposome in an aqueous solvent and accessible to aqueous medium outside of the liposome.

As used herein, "charge complexed" refers to an electrostatic association.

As used herein, the term "operatively associated" refers to an electronic interaction between a compound as described herein, a therapeutic agent, a retinoid, and/or a second lipid. Such interaction may take the form of a chemical bond, including, but not limited to, a covalent bond, a polar covalent bond, an ionic bond, an electrostatic association, a coordinate covalent bond, an aromatic bond, a hydrogen bond, a dipole, or a van der Waals interaction. Those of ordinary skill in the art understand that the relative strengths of such interactions may vary widely.

The term "liposome" is used herein in its ordinary meaning as understood by those skilled in the art, and refers to a lipid bilayer structure that contains lipids attached to polar, hydrophilic structures which form a substantially closed structure in aqueous media. In some embodiments, the liposome can be operatively associated with one or more compounds, such as a therapeutic agent and a retinoid or retinoid conjugate. A liposome may be comprised of a single lipid bilayer (i.e., unilamellar) or it may comprised of two or more lipid bilayers (i.e., multilamellar). While the interior of a liposome may consist of a variety of compounds, the exterior of the liposome is accessible to the aqueous formulation comprising the liposome. A liposome can be approximately spherical or ellipsoidal in shape.

As referred to herein, "vitamin D" is a generic descriptor for a group of vitamins having antirachitic activity. The vitamin D group includes: vitamin $D_2$ (calciferol), vitamin $D_3$ (irradiated 22-dihydroergosterol), vitamin $D_4$ (irradiated dehydrositosterol) and vitamin $D_5$ (irradiated dehydrositosterol).

As referred to herein, "vitamin E" is a generic descriptor for a group of molecules with antioxidant activity. The vitamin E family includes α-tocopherol, β-tocopherol, γ-tocopherol and δ-tocopherol, with α-tocopherol being the most prevalent (Brigelius-Flohe and Traber, *The FASEB Journal*. 1999; 13:1145-1155).

As referred to herein, "vitamin K" is generic descriptor for an anti-hemorrhagic factor and includes vitamin $K_1$ (phytonadione), vitamin $K_2$ (menaquinone), vitamin $K_3$, vitamin $K_4$ and vitamin $K_5$. Vitamins $K_1$ and $K_2$ are natural, while $K_{3-5}$ are synthetic.

The term "facilitating drug delivery to a target cell" refers the enhanced ability of the present retinoid or fat soluble vitamin compounds to enhance delivery of a therapeutic molecule such as siRNA to a cell. While not intending to be bound by theory, the retinoid or fat-soluble vitamin compound interacts with a specific receptor or [activation/binding site] on a target cell with specificity that can be measured. For example, binding is generally consider specific when binding affinity ($K_a$) of $10^6 M^{-1}$ or greater, preferably $10^7 M^{-1}$ or greater, more preferably $10^8 M^{-1}$ or greater, and most preferably $10^9 M^{-1}$ or greater. The binding affinity of an antibody can be readily determined by one of ordinary skill in the art, for example, by Scatchard analysis (Scatchard, Ann. NY Acad. Sci. 51:660, 1949).

Active Pharmaceutical Ingredient

The present description relates to a drug carrier and a drug carrier kit that enable a diagnostic and/or therapeutic drug to be specifically transported to stellate cells. The drug carrier in the present description may be selected from liposomes and nanoparticles, and by bonding thereto or including therein a retinoid or retinoid conjugate and a therapeutic drug that can be transported specifically to HSC. Retinoids include vitamin A, retinal, retinoic acid, saturated vitamin A, tretinoin, adapalene, or retinol palmitate, and fenretinide (4-hydroxy(phenyl)retinamide; 4-HPR). Furthermore, by preparing the drug carrier to include one molecule or a plurality of molecules selected from transforming growth factor beta (TGFβ) activity inhibitors such as a truncated TGFβ type II receptor and a soluble TGFβ type II receptor, growth factor preparations such as hepatocyte growth factor (HGF), matrix metalloproteinase (MMP) production promoters such as an MMP gene-containing adenovirus vector, a cell activation inhibitors and/or growth inhibitors including a peroxisome proliferator-activated receptor gamma ligand (PPARγ-ligand), an angiotensin-II type I receptor antagonist, a platelet-derived growth factor (PDGF) tyrosine kinase inhibitor, and a sodium channel inhibitor such as amiloride, and apoptosis inducers such as herbal compound 861 and gliotoxin; and by administering it for example, orally, parenterally, intravenously or intraperitoneally to a patient having a risk of fibrosis or fibrosis symptoms, or patients having various fibrosis-related disorders such as, for example, hepatic cirrhosis, hepatic failure, liver cancer, or chronic pancreatitis, the activation of stellate cells can be suppressed, and thereby preventing, inhibiting or improving the fibrosis and/or fibrosis-related disease conditions in said patient. Alternatively, or in addition thereto, by using the drug carrier which encloses therein a ribozyme, an antisense RNA, or an siRNA that specifically inhibits HSP47 or tissue inhibitors of metalloproteinase (TIMP), which is an MMP inhibitor, secretion of type I to IV collagens can be simultaneously inhibited, and as a result fibrogenesis can be inhibited effectively.

An embodiment of the description is a pharmaceutical composition comprising a double-stranded nucleic acid molecule comprising a sense strand and an antisense strand wherein the sense and antisense strands are selected from the oligonucleotides described as SERPINH1_2 (SEQ ID NOS: 60 and 127, referring to the Sequence Listing filed herewith), SERPINH1_45a (SEQ ID NOS:98 and 165), and SERPINH1_51 (SEQ ID NOS:101 and 168), and a drug carrier comprising a mixture of a lipid vesicle and a retinoid or a retinoid conjugate. The retinoid can be one or more of the following: vitamin A, retinoic acid, saturated vitamin A, retinal, tretinoin, adapalene, retinol palmitate, or fenretinide. Preferably, the retinoid comprises a conjugate of retinoic acid, most preferably a retinoid-PEG conjugate. The lipid vesicle can be comprised of a bilayer of lipid molecules, and can further be comprised of the retinoid. The retinoid is preferably at a concentration of 0.2 to 20 wt % in the drug carrier. The lipid vesicle can be comprised of an interior surface that encapsulates the interior of the lipid vesicle, and an exterior surface that is accessible to an aqueous medium outside of the lipid vesicle. The retinoid may be associated with the lipid bilayer. The double-stranded nucleic acid can be exposed on the exterior surface of the lipid vesicle.

In some embodiments, the double-stranded nucleic acid molecule includes an antisense strand having SEQ ID NO:127 and comprising 2'-O-methyl sugar (2'OMe)-modified ribonucleotides; a 2'-5'-ribonucleotide in at least one of positions 1, 5, 6, or 7; and a 3'-terminal non-nucleotide moiety covalently attached to the 3'-terminus; and a sense strand having SEQ ID NO:60 and comprising at least one 2'-5'-ribonucleotide or 2'OMe modified ribonucleotide; a non-nucleotide moiety covalently attached at the 3'-terminus; and an inverted abasic moiety covalently attached at the 5'-terminus. In preferred embodiments the antisense strand is SEQ ID NO:127 and comprises 2'OMe modified ribonucleotides at positions 3, 5, 9, 11, 13, 15, 17, and 19; a 2'-5'-ribonucleotide in position 7; and a non-nucleotide moiety covalently attached at the 3'-terminus; and the sense strand is SEQ ID NO:60 and comprises five consecutive 2'-5'-ribonucleotides in the 3'-terminal positions 15, 16, 17, 18, and 19; a non-nucleotide moiety covalently attached at the 3'-terminus; and an inverted abasic moiety covalently attached at the 5'-terminus. In some embodiments the double-stranded nucleic acid molecule further includes a 2'OMe modified ribonucleotide or a 2'-5'-ribonucleotide at position 1 of the antisense strand. (All reference herein to nucleotide positions are expressed based on the 5'>3' direction of the oligonucleotide for both sense and antisense strands of the double-stranded nucleic acid molecule.)

In various embodiments, the sense strand is SEQ ID NO:98 and comprises 2'-5'-ribonucleotides in positions at the 3'-terminus; a non-nucleotide moiety covalently attached at the 3'-terminus; and an inverted abasic moiety covalently attached at the 5'-terminus; and the antisense strand is SEQ ID NO:165 and comprises 2'OMe modified ribonucleotides; a 2'-5'-ribonucleotide in at least one of positions 5, 6 or 7; and a non-nucleotide moiety covalently attached at the 3'-terminus. In preferred embodiments the sense strand is SEQ ID NO:98 and comprises 2'-5'-ribonucleotides in positions 15, 16, 17, 18, and 19; a C3-OH 3' moiety covalently attached at the 3'-terminus; and an inverted abasic deoxyribonucleotide moiety covalently attached at the 5'-terminus; and the antisense strand is SEQ ID NO:165 and comprises 2'OMe modified ribonucleotides in positions 4, 6, 8, 11, 13, 15, 17, and 19; a 2'-5'-ribonucleotide in position 7; and a C3Pi-C3OH moiety covalently attached at the 3'-terminus. In some embodiments the double-stranded nucleic acid further comprises a 2'OMe modified ribonucleotide in position 2.

In various embodiments, the sense strand is SEQ ID NO:101 and comprises 2'OMe modified ribonucleotides; an optional 2'-5'-ribonucleotide in one of position 9 or 10; a non-nucleotide moiety covalently attached at the 3'-terminus; and an inverted abasic moiety covalently attached at the 5'-terminus; and the antisense strand is SEQ ID NO:168 and comprises 2'OMe modified ribonucleotides; a 2'-5'-ribonucleotide in at least one of positions 5, 6, or 7; and a non-nucleotide moiety covalently attached at the 3'-terminus. In preferred embodiments the sense strand is SEQ ID NO:101 and comprises 2'OMe modified ribonucleotides in positions 4, 11, 13, and 17; a 2'-5'-ribonucleotide in position 9; a C3OH non-nucleotide moiety covalently attached at the 3'-terminus; and inverted abasic deoxyribonucleotide moiety covalently attached at the 5'-terminus; and the antisense strand is SEQ ID NO:168 and comprises 2'OMe modified ribonucleotides in positions 1, 4, 8, 11 and 15; a 2'-5'-ribonucleotide in position 6; and a C3Pi-C3OH moiety covalently attached at the 3'-terminus. In certain embodiments the double-stranded nucleic acid molecule further comprises a 2'OMe modified ribonucleotide in position 13 in the antisense strand and or in position 2 in the sense strand.

Another aspect is a pharmaceutical composition comprising a double-stranded nucleic acid molecule and drug carrier comprising a mixture of a retinoid and a lipid, wherein the double-stranded oligonucleotide compound comprising the structure (A1):

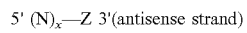

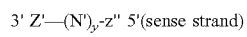

(A1)

wherein each of N and N' is a nucleotide which may be unmodified or modified, or an unconventional moiety;

wherein each of (N)$_x$ and (N')$_y$ is an oligonucleotide in which each consecutive N or N' is joined to the next N or N' by a covalent bond;

wherein each of Z and Z' is independently present or absent, but if present independently includes 1-5 consecutive nucleotides or non-nucleotide moieties or a combination thereof covalently attached at the 3'-terminus of the strand in which it is present;

wherein z" may be present or absent, but if present is a capping moiety covalently attached at the 5'-terminus of (N')$_y$;

wherein each of x and y is independently an integer between 18 and 40;

wherein the sequence of (N')$_y$ has complementary to the sequence of (N)$_x$, and wherein (N)$_x$ includes an antisense sequence to the mRNA coding sequence for human hsp47 exemplified by SEQ ID NO:1.

Compositions, methods and kits for modulating expression of target genes are provided herein. In various aspects and embodiments, compositions, methods and kits provided herein modulate expression of heat shock protein 47 (hsp47), also known as SERPINH1 (SEQ ID NO:1). The compositions, methods and kits may involve use of nucleic acid molecules (for example, short interfering nucleic acid (siNA), short interfering RNA (siRNA), double-stranded RNA (dsRNA), micro-RNA (miRNA), or short hairpin RNA (shRNA)) that bind a nucleotide sequence (such as an mRNA sequence) encoding hsp47, SEQ ID NO:1. In certain preferred embodiments, the compositions, methods and kits disclosed herein inhibit expression of hsp47. For example, siNA molecules (e.g., RNA-induced silencing complex (RISC) length dsNA molecules or Dicer length dsNA molecules) are provided that reduce or inhibit hsp47 expression. Also provided are compositions, methods and kits for treating and/or preventing diseases, conditions or disorders associated with hsp47, such as liver fibrosis, cirrhosis, pulmonary fibrosis including lung fibrosis (including interstitial lung fibrosis (ILF)), kidney fibrosis resulting from any condition (e.g., chronic kidney disease (CKD) including End-Stage Renal Disease (ESRD)), peritoneal fibrosis, chronic hepatic damage, fibrillogenesis, fibrotic diseases in other organs, abnormal scarring (keloids) associated with all possible types of skin injury accidental and jatrogenic (operations); scleroderma; cardiofibrosis, failure of glaucoma filtering operation; and intestinal adhesions.

In one aspect, provided are the pharmaceutical compositions, above, comprising nucleic acid molecules (e.g., siNA molecules) as a component of a pharmaceutical formulation in which the nucleic acid molecule includes a sense strand and an antisense strand; each strand of the nucleic acid molecule is independently 15 to 49 nucleotides (nt) in length; a 15 to 49 nt sequence of the antisense strand is complementary to a sequence of an mRNA encoding human hsp47 (e.g., SEQ ID NO:1); and a 15 to 49 nt sequence of the sense strand is complementary to the a sequence of the antisense strand and includes a 15 to 49 nt sequence of an mRNA encoding human hsp47 (e.g., SEQ ID NO:1).

In certain embodiments, the sequence of the antisense strand that is complementary to a sequence of an mRNA encoding human hsp47 includes a sequence complimentary to a sequence between nucleotides 600-800; or 801-899; or 900-1000; or 1001-1300 of SEQ ID NO:1; or between nucleotides 650-730; or 900-975 of SEQ ID NO:1. In some embodiments, the antisense strand includes a sequence that is complementary to a sequence of an mRNA encoding human hsp47 corresponding to nucleotides 674-693 of SEQ ID NO:1 or a portion thereof; or nucleotides 698-716 of SEQ ID NO:1 or a portion thereof; or nucleotides 698-722 of SEQ ID NO:1 or a portion thereof; or nucleotides 701-720 of SEQ ID NO:1 or a portion thereof, or nucleotides 920-939 of SEQ ID NO:1 or a portion thereof; or nucleotides 963-982 of SEQ ID NO:1 or a portion thereof; or nucleotides 947-972 of SEQ ID NO:1 or a portion thereof; or nucleotides 948-966 of SEQ ID NO:1 or a portion thereof; or nucleotides 945-969 of SEQ ID NO:1 or a portion thereof; or nucleotides 945-963 of SEQ ID NO:1 or a portion thereof.

In certain embodiments, the antisense strand of a nucleic acid molecule (e.g., a siNA molecule) as disclosed herein as a component of a pharmaceutical formulation includes a sequence corresponding to SEQ ID NO:4 or a portion thereof; or SEQ ID NO:6 or a portion thereof, or SEQ ID NO:8 or a portion thereof, or SEQ ID NO:10 or a portion thereof, or SEQ ID NO:12 or a portion thereof, or SEQ ID NO:14 or a portion thereof, or SEQ ID NO:16 or a portion thereof; or SEQ ID NO:18 or a portion thereof, or SEQ ID NO:20 or a portion thereof, or SEQ ID NO:22 or a portion thereof; or SEQ ID NO:24 or a portion thereof, or SEQ ID NO:26 or a portion thereof, or SEQ ID NO:28 or a portion thereof, or SEQ ID NO:30 or a portion thereof; or SEQ ID NO:32 or a portion thereof, or SEQ ID NO:34 or a portion thereof; or SEQ ID NO:36 or a portion thereof, or SEQ ID NO:38 or a portion thereof, or SEQ ID NO:40 or a portion thereof, or SEQ ID NO:42 or a portion thereof; or SEQ ID NO:44 or a portion thereof, or SEQ ID NO:46 or a portion thereof, or SEQ ID NO:48 or a portion thereof; or SEQ ID NO:50 or a portion thereof; or SEQ ID NO:52 or a portion thereof; or SEQ ID NO:54 or a portion thereof, or SEQ ID NO:56 or a portion thereof, or SEQ ID NO:58 or a portion thereof. In certain embodiments, the sense strand of a nucleic acid molecule (e.g., a siNA molecule) as disclosed herein includes a sequence corresponding to SEQ ID NO:3 or a portion thereof, or SEQ ID NO:5 or a portion thereof, or SEQ ID NO:7 or a portion thereof, or SEQ ID NO:9 or a portion thereof, or SEQ ID NO:11 or a portion thereof, or SEQ ID NO:13 or a portion thereof, or SEQ ID NO:15 or a portion thereof, or SEQ ID NO:17 or a portion thereof, or SEQ ID NO:19 or a portion thereof, or SEQ ID NO:21 or a portion thereof; or SEQ ID NO:23 or a portion thereof, or SEQ ID NO:25 or a portion thereof, or SEQ ID NO:27 or a portion thereof; or SEQ ID NO:29 or a portion thereof, or SEQ ID NO:31 or a portion thereof, or SEQ ID NO:33 or a portion thereof, or SEQ ID NO:35 or a portion thereof, or SEQ ID NO:37 or a portion thereof, or SEQ ID NO:39 or a portion thereof, or SEQ ID NO:41 or a portion thereof; or SEQ ID NO:43 or a portion thereof, or SEQ ID NO:45 or a portion thereof, or SEQ ID NO:47 or a portion thereof, or SEQ ID NO:49 or a portion thereof, or SEQ ID NO:51 or a portion thereof, or SEQ ID NO:53 or a portion thereof, or SEQ ID NO:55 or a portion thereof; or SEQ ID NO:57 or a portion thereof.

In certain preferred embodiments, the antisense strand of a nucleic acid molecule (e.g., a siNA molecule) as disclosed herein as a component of a pharmaceutical formulation includes a sequence corresponding to any one of the antisense sequences described herein and in applications US 20140356413 and US 20130071478, incorporated by reference herein. In some embodiments the antisense and sense strands are selected from the sequence pairs set forth in SERPINH1_4, SERPINH1_12, SERPINH1_18, SERPINH1_30, SERPINH1_58 and SERPINH1_88. In some embodiments the antisense and sense strands are selected from the sequence pairs set forth in SERPINH1_4 (SEQ ID NOS:195 and 220), SERPINH1_12 (SEQ ID NOS:196 and 221), SERPINH1_30 (SEQ ID NOS:199 and 224), and SERPINH1_58 (SEQ ID NOS:208 and 233).

In some embodiments, the antisense and sense strands of a nucleic acid molecule (e.g., a siNA molecule) as disclosed herein as a component of a pharmaceutical formulation includes the sequence pairs set forth in SERPINH1_4 (SEQ ID NOS:195 and 220). In some embodiments of a nucleic acid molecule (e.g., a siNA molecule) as disclosed herein includes the antisense and sense strands of the sequence pairs set forth in SERPINH1_12 (SEQ ID NOS:196 and 221). In some embodiments the antisense and sense strands of a nucleic acid molecule (e.g., a siNA molecule) as disclosed herein includes the sequence pairs set forth in SERPINH1_30 (SEQ ID NOS:199 and 224). In some embodiments of a nucleic acid molecule (e.g., a siNA molecule) as disclosed herein includes the antisense and sense strands of the sequence pairs set forth in SERPINH1_58 (SEQ ID NOS:208 and 233).

In certain embodiments, the antisense strand of a nucleic acid molecule (e.g., a siNA molecule) as disclosed herein as a component of a pharmaceutical formulation includes a sequence corresponding to any one of the antisense sequences described in US 20140356413 and US 20130071478, incorporated by reference herein.

In certain preferred embodiments, the antisense strand of a nucleic acid molecule (e.g., a siNA molecule) as disclosed herein as a component of a pharmaceutical formulation includes a sequence corresponding to any one of the antisense sequences described in applications US 20140356413 and US 20130071478. In certain preferred embodiments the antisense strand and the sense strand are selected from the sequence pairs shown in Table 5 of application US 20140356413. In some embodiments of a nucleic acid molecule (e.g., a siNA molecule) as disclosed herein includes the antisense and sense strands selected from the sequence pairs set forth in SERPINH1_2 (SEQ ID NOS:60 and 127), SERPINH1_6 (SEQ ID NOS:63 and 130), SERPINH1_11 (SEQ ID NOS:68 and 135), SERPINH1_13 (SEQ ID NOS:69 and 136), SERPINH1_45 (SEQ ID NOS: 97 and 164), SERPINH1_45a (SEQ ID NOS:98 and 165), SERPINH1_51 (SEQ ID NOS:101 and 168), SERPINH1_52 (SEQ ID NOS:102 and 169) or SERPINH1_86 (SEQ ID NOS:123 and 190).

In some preferred embodiments the antisense and sense strands are selected from the sequence pairs set forth in SERPINH1_2 (SEQ ID NOS:60 and 127), SERPINH1_6 (SEQ ID NOS:63 and 130), SERPINH1_45a (SEQ ID NOS:98 and 165), and SERPINH1_51 (SEQ ID NOS:101 and 168).

In some preferred embodiments of a nucleic acid molecule (e.g., a siNA molecule) as disclosed herein as a component of a pharmaceutical formulation includes the antisense and sense strands selected from the sequence pairs set forth in SERPINH1_2 (SEQ ID NOS:60 and 127). In some embodiments the antisense and sense strands include the sequence pairs set forth in SERPINH1_6 (SEQ ID NOS:63 and 130). In some embodiments of a nucleic acid molecule (e.g., a siNA molecule) as disclosed herein includes the antisense and sense strands of the sequence pairs set forth in SERPINH1_11 (SEQ ID NOS:68 and 135). In some embodiments the antisense and sense strands are the sequence pairs set forth in SERPINH1_13 (SEQ ID NOS:69 and 136). In some embodiments the antisense and sense strands are the sequence pairs set forth in SERPINH1_45 (SEQ ID NOS:97 and 164). In some embodiments the antisense and sense strands are the sequence pairs set forth in SERPINH1_45a (SEQ ID NOS:98 and 165). In some embodiments the antisense and sense strands are the sequence pairs set forth in SERPINH1_51 (SEQ ID NOS: 101 and 168).

In certain embodiments, the antisense strand of a nucleic acid molecule (e.g., a siNA molecule) as disclosed as a component of a pharmaceutical formulation herein includes a sequence corresponding to any one of the antisense sequences shown on any one of Tables D or E of application US 20140356413.

In various embodiments of nucleic acid molecules (e.g., siNA molecules) as disclosed herein as a component of a pharmaceutical formulation, the antisense strand may be 15 to 49 nt in length (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nt in length); or 17-35 nt in length; or 17-30 nt in length; or 15-25 nt in length; or 18-25 nt in length; or 18-23 nt in length; or 19-21 nt in length; or 25-30 nt in length; or 26-28 nt in length. In some embodiments of nucleic acid molecules (e.g., siNA molecules) as disclosed herein, the antisense strand may be 19 nt in length. Similarly, the sense strand of nucleic acid molecules (e.g., siNA molecules) as disclosed herein may be 15 to 49 nt in length (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nt in length); or 17-35 nt in length; or 17-30 nt in length; or 15-25 nt in length; or 18-25 nt in length; or 18-23 nt in length; or 19-21 nt in length; or 25-30 nt in length; or 26-28 nt in length. In some embodiments of nucleic acid molecules (e.g., siNA molecules) as disclosed herein, the sense strand may be 19 nt in length. In some embodiments of nucleic acid molecules (e.g., siNA molecules) as disclosed herein, the antisense strand and the sense strand may be 19 nt in length. The duplex region of the nucleic acid molecules (e.g., siNA molecules) as disclosed herein may be 15-49 nt in length (e.g., about 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nt in length), 15-35 nt in length; or 15-30 nt in length; or about 15-25 nt in length; or 17-25 nt in length; or 17-23 nt in length; or 17-21 nt in length; or 25-30 nt in length; or 25-28 nt in length. In various embodiments of nucleic acid molecules (e.g., siNA molecules) as disclosed herein, the duplex region may be 19 nt in length.

In certain embodiments, the sense and antisense strands of a nucleic acid (e.g., an siNA nucleic acid molecule) as provided herein as a component of a pharmaceutical formulation are separate polynucleotide strands. In some embodiments, the separate antisense and sense strands form a double-stranded structure via hydrogen bonding, for example, Watson-Crick base pairing. In some embodiments, the sense and antisense strands are two separate strands that are covalently linked to each other. In other embodiments, the sense and antisense strands are part of a single polynucleotide strand having both a sense and antisense region; in some preferred embodiments the polynucleotide strand has a hairpin structure.

In certain embodiments, the nucleic acid molecule (e.g., siNA molecule) is a double-stranded nucleic acid (dsNA) molecule that is symmetrical with regard to overhangs, and has a blunt end on both ends. In other embodiments, the nucleic acid molecule (e.g., siNA molecule) is a dsNA molecule that is symmetrical with regard to overhangs, and has an overhang on both ends of the dsNA molecule; preferably the molecule has overhangs of 1, 2, 3, 4, 5, 6, 7, or 8 nt; preferably the molecule has 2 nucleotide overhangs. In some embodiments, the overhangs are 5' overhangs; in alternative embodiments, the overhangs are 3' overhangs. In certain embodiments, the overhang nucleotides are modified with modifications as disclosed herein. In some embodiments, the overhang nucleotides are 2'-deoxynucleotides.

In certain preferred embodiments, the nucleic acid molecule (e.g., siNA molecule) as a component of a pharmaceutical formulation is a dsNA molecule that is asymmetrical with regard to overhangs, and has a blunt end on one end of the molecule and an overhang on the other end of the molecule. In certain embodiments, the overhang is 1, 2, 3, 4, 5, 6, 7, or 8 nt; preferably the overhang is 2 nt. In some preferred embodiments, an asymmetrical dsNA molecule has a 3'-overhang (for example a two nucleotide 3'-overhang) on one side of a duplex occurring on the sense strand; and a blunt end on the other side of the molecule. In some preferred embodiments, an asymmetrical dsNA molecule has a 5'-overhang (for example a two nucleotide 5'-overhang) on one side of a duplex occurring on the sense strand; and a blunt end on the other side of the molecule. In other preferred embodiments, an asymmetrical dsNA molecule has a 3'-overhang (for example a two nucleotide 3'-overhang) on one side of a duplex occurring on the antisense strand; and a blunt end on the other side of the molecule. In some preferred embodiments, an asymmetrical dsNA molecule has a 5'-overhang (for example a two nucleotide 5'-overhang) on one side of a duplex occurring on the antisense strand; and a blunt end on the other side of the molecule. In certain preferred embodiments, the overhangs are 2'-deoxynucleotides.

In some embodiments, the nucleic acid molecule (e.g., siNA molecule) as a component of a pharmaceutical formulation has a hairpin structure (having the sense strand and antisense strand on one polynucleotide), with a loop structure on one end and a blunt end on the other end. In some embodiments, the nucleic acid molecule has a hairpin structure, with a loop structure on one end and an overhang end on the other end (for example a 1, 2, 3, 4, 5, 6, 7, or 8 nucleotide overhang); in certain embodiments, the overhang is a 3'-overhang; in certain embodiments the overhang is a 5'-overhang; in certain embodiments the overhang is on the sense strand; in certain embodiments the overhang is on the antisense strand.

In some preferred embodiments, the nucleic acid molecule is selected from the nucleic acid molecules shown on Table 3.

The nucleic acid molecules (e.g., siNA molecule) disclosed herein as a component of a pharmaceutical formulation may include one or more modifications or modified nucleotides such as described herein. For example, a nucleic acid molecule (e.g., siNA molecule) as provided herein may include a modified nucleotide having a modified sugar; a modified nucleotide having a modified nucleobase; or a modified nucleotide having a modified phosphate group. Similarly, a nucleic acid molecule (e.g., siNA molecule) as provided herein may include a modified phosphodiester backbone and/or may include a modified terminal phosphate group.

Nucleic acid molecules (e.g., siNA molecules) as provided as a component of a pharmaceutical formulation may have one or more nucleotides that include a modified sugar moiety, for example as described herein. In some preferred embodiments, the modified sugar moiety is selected from the group consisting of 2'OMe, 2'-methoxyethoxy, 2'-deoxy, 2'-fluoro, 2'-allyl, 2'-O-(2-(methylamino)-2-oxoethyl), 4'-thio, 4'-(CH$_2$)$_2$—O-2'-bridge, 2'-LNA (the ribose moiety of an LNA nucleotide is modified with an extra bridge connecting the 2' oxygen and 4' carbon), and 2'-O—(N-methylcarbamate).

Nucleic acid molecules (e.g., siNA molecules) as provided as a component of a pharmaceutical formulation may have one or more modified nucleobase(s) for example as described herein, which preferably may be one selected from the group consisting of xanthine, hypoxanthine, 2-aminoadenine, 6-methyl and other alkyl derivatives of adenine and guanine, 2-propyl and other alkyl derivatives of adenine and guanine, 5-halo uracil and cytosine, 5-propynyl uracil and cytosine, 6-azo uracil, cytosine and thymine, 5-uracil (pseudouracil), 4-thiouracil, 8-halo, amino, thiol, thioalkyl, hydroxyl and other 8-substituted adenines and guanines, 5-trifluoromethyl and other 5-substituted uracils and cytosines, 7-methylguanine, and acyclonucleotides.

Nucleic acid molecules (e.g., siNA molecules) as provided as a component of a pharmaceutical formulation may have one or more modifications to the phosphodiester backbone, for example as described herein. In some preferred embodiments, the phosphodiester bond is modified by substituting the phosphodiester bond with a phosphorothioate, 3'-(or 5'-) deoxy-3'-(or 5'-)thio-phosphorothioate, phosphorodithioate, phosphoroselenates, 3'-(or -5')deoxy phosphinates, borano phosphates, 3'-(or 5'-)deoxy-3'-(or 5'-)amino phosphoramidates, hydrogen phosphonates, borano phosphate esters, phosphoramidates, alkyl or aryl phosphonates and phosphotriester or phosphorus linkages.

In various embodiments, the provided nucleic acid molecules (e.g., siNA molecules) as a component of a pharmaceutical formulation may include one or more modifications in the sense strand but not the antisense strand. In some embodiments, the provided nucleic acid molecules (e.g., siNA molecules) include one or more modifications in the antisense strand but not the sense strand. In some embodiments, the provided nucleic acid molecules (e.g., siNA molecules) include one or more modifications in the both the sense strand and the antisense strand.

In some embodiments in which the provided nucleic acid molecules (e.g., siNA molecules) as a component of a pharmaceutical formulation have modifications, the sense strand includes a pattern of alternating modified and unmodified nucleotides, and/or the antisense strand includes a pattern of alternating modified and unmodified nucleotides; in some preferred versions of such embodiments, the modification is a 2'OMe moiety. The pattern of alternating modified and unmodified nucleotides may start with a modified nucleotide at the 5'-end or 3'-end of one of the strands; for example the pattern of alternating modified and unmodified nucleotides may start with a modified nucleotide at the 5'-end or 3'-end of the sense strand and/or the pattern of alternating modified and unmodified nucleotides may start with a modified nucleotide at the 5'-end or 3'-end of the antisense strand. When both the antisense and sense strand include a pattern of alternating modified nucleotides, the pattern of modified nucleotides may be configured such that modified nucleotides in the sense strand are opposite modified nucleotides in the antisense strand; or there may be a phase shift in the pattern such that modified nucleotides of the sense strand are opposite unmodified nucleotides in the antisense strand and vice-versa.

The nucleic acid molecules (e.g., siNA molecules) as provided herein as a component of a pharmaceutical formulation may include one to three (i.e., 1, 2 or 3) deoxynucleotides at the 3'-end of the sense and/or antisense strand.

The nucleic acid molecules (e.g., siNA molecules) as provided herein as a component of a pharmaceutical formulation may include a phosphate group at the 5'-end of the sense and/or antisense strand.

In one aspect, provided as a component of a pharmaceutical formulation are double-stranded nucleic acid molecules having the structure (A1):

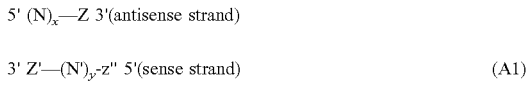

wherein each of N and N' is a nucleotide which may be unmodified or modified, or an unconventional moiety;
wherein each of $(N)_x$ and $(N')_y$ is an oligonucleotide in which each consecutive N or N' is joined to the next N or N' by a covalent bond;
wherein each of Z and Z' is independently present or absent, but if present independently includes 1-5 consecutive nucleotides or non-nucleotide moieties or a combination thereof covalently attached at the 3'-terminus of the strand in which it is present;
wherein z" may be present or absent, but if present is a capping moiety covalently attached at the 5'-terminus of $(N')_y$;
wherein each of x and y is independently an integer between 18 and 40;
wherein the sequence of $(N')_y$ has complementary to the sequence of $(N)_x$; and wherein $(N)_x$ includes an antisense sequence to SEQ ID NO:1.

In some embodiments, $(N)_x$ includes an antisense oligonucleotide present in Tables 4A and. In other embodiments, $(N)_x$ is selected from an antisense oligonucleotide present in Tables B or C.

In some embodiments, the covalent bond joining each consecutive N or N' is a phosphodiester bond.

In some embodiments, x=y and each of x and y is 19, 20, 21, 22 or 23. In various embodiments, x=y=19.

In some embodiments of nucleic acid molecules (e.g., siNA molecules) as disclosed herein, the double-stranded nucleic acid molecule is a siRNA, siNA or a miRNA.

In some embodiments, the antisense and sense strands are selected from the sequence pairs set forth in SERPINH1_4 (SEQ ID NOS:195 and 220), SERPINH1_12 (SEQ ID NOS:196 and 221), SERPINH1_30 (SEQ ID NOS:199 and 224), and SERPINH1_58 (SEQ ID NOS:208 and 233).

In some embodiments, the antisense and sense strands are the sequence pairs set forth in SERPINH1_4 (SEQ ID NOS:195 and 220). In some embodiments, the antisense and sense strands are the sequence pairs set forth in SERPINH1_12 (SEQ ID NOS:196 and 221). In some embodiments, the antisense and sense strands are the sequence pairs set forth in SERPINH1_30 (SEQ ID NOS:199 and 224). In some embodiments, the antisense and sense strands are the sequence pairs set forth in SERPINH1_58 (SEQ ID NOS: 208 and 233).

In some embodiments, the double-stranded nucleic acid molecules as a component of a pharmaceutical formulation comprise a DNA moiety or a mismatch to the target at position 1 of the antisense strand (5'-terminus). Such a structure is described herein. According to one embodiment provided are modified nucleic acid molecules having a structure (A2) set forth below:

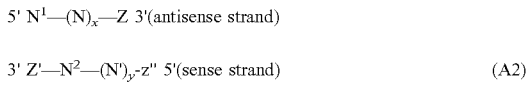

wherein each of $N^2$, N and N' is an unmodified or modified ribonucleotide, or an unconventional moiety;
wherein each of $(N)_x$ and $(N')_y$ is an oligonucleotide in which each consecutive N or N' is joined to the adjacent N or N' by a covalent bond;
wherein each of x and y is independently an integer between 17 and 39;
wherein the sequence of $(N')_y$ has complementarity to the sequence of $(N)$, and $(N)_x$ has complementarity to a consecutive sequence in a target RNA;
wherein $N^1$ is covalently bound to $(N)_x$ and is mismatched to the target RNA or is a complementary DNA moiety to the target RNA;
wherein $N^1$ is a moiety selected from the group consisting of natural or modified uridine, deoxyribouridine, ribothymidine, deoxyribothymidine, adenosine or deoxyadenosine;
wherein z" may be present or absent, but if present is a capping moiety covalently attached at the 5'-terminus of $N^2$—$(N')_y$; and
wherein each of Z and Z' is independently present or absent, but if present is independently 1-5 consecutive nucleotides, consecutive non-nucleotide moieties or a combination thereof covalently attached at the 3'-terminus of the strand in which it is present.

In some embodiments, the sequence of $(N')_y$ is fully complementary to the sequence of $(N)_x$. In various embodiments, sequence of $N^2$—$(N')_y$ is complementary to the sequence of $N^1$—$(N)_x$. In some embodiments, $(N)_x$ comprises an antisense that is fully complementary to about 17 to about 39 consecutive nucleotides in a target RNA. In other embodiments, $(N)_x$ comprises an antisense that is substantially complementary to about 17 to about 39 consecutive nucleotides in a target RNA.

In some embodiments, $N^1$ and $N^2$ form a Watson-Crick base pair. In some embodiments, $N^1$ and $N^2$ form a non-Watson-Crick base pair. In some embodiments, a base pair is formed between a ribonucleotide and a deoxyribonucleotide.

In some embodiments, x=y=18, x=y=19 or x=y=20. In preferred embodiments, x=y=18. When x=18 in $N^1$—$(N)x$, $N^1$ refers to position 1 and positions 2-19 are included in $(N)_{18}$. When y=18 in $N^2$—$(N')_y$, $N^2$ refers to position 19 and positions 1-18 are included in $(N')_{18}$.

In some embodiments, $N^1$ is covalently bound to $(N)x$ and is mismatched to the target RNA. In various embodiments, $N^1$ is covalently bound to $(N)_x$ and is a DNA moiety complementary to the target RNA.

In some embodiments, a uridine in position 1 of the antisense strand is substituted with an $N^1$ selected from adenosine, deoxyadenosine, deoxyuridine (dU), ribothymidine or deoxythymidine. In various embodiments, $N^1$ is selected from adenosine, deoxyadenosine or deoxyuridine.

In some embodiments, guanosine in position 1 of the antisense strand is substituted with an $N^1$ selected from adenosine, deoxyadenosine, uridine, deoxyuridine, ribothymidine or deoxythymidine. In various embodiments, $N^1$ is selected from adenosine, deoxyadenosine, uridine or deoxyuridine.

In some embodiments, cytidine in position 1 of the antisense strand is substituted with an $N^1$ selected from adenosine, deoxyadenosine, uridine, deoxyuridine, ribothymidine or deoxythymidine. In various embodiments, $N^1$ is selected from adenosine, deoxyadenosine, uridine or deoxyuridine.

In some embodiments, adenosine in position 1 of the antisense strand is substituted with an $N^1$ selected from deoxyadenosine, deoxyuridine, ribothymidine or deoxythymidine. In various embodiments, $N^1$ selected from deoxyadenosine or deoxyuridine.

In some embodiments, $N^1$ and $N^2$ form a base pair between uridine or deoxyuridine, and adenosine or deoxyadenosine. In other embodiments, $N^1$ and $N^2$ form a base pair between deoxyuridine and adenosine.

In some embodiments, the double-stranded nucleic acid molecule as a component of a pharmaceutical formulation is a siRNA, siNA or a miRNA. The double-stranded nucleic acid molecules as provided herein are also referred to as "duplexes".

In some embodiments $(N)_x$ includes an antisense oligonucleotide present in Table 5. In some embodiments, $x=y=18$ and $N^1-(N)_x$ includes an antisense oligonucleotide present in Table 4. In some embodiments $x=y=19$ or $x=y=20$. In certain preferred embodiments, $x=y=18$. In some embodiments $x=y-18$ and the sequences of $N^1-(N)_x$ and $N^2-(N')_y$ are selected from the pair of oligonucleotides set forth in Table 4 of US 20140356413. In some embodiments, $x=y=18$ and the sequences of $N^1-(N)_x$ and $N^2-(N')_y$ are selected from the pair of oligonucleotides set forth in Tables D and E of US 20140356413. In some embodiments, the antisense and sense strands are selected from the sequence pairs set forth in SERPINH1_2 (SEQ ID NOS:60 and 127), SERPINH1_6 (SEQ ID NOS:63 and 130), SERPINH1_11 (SEQ ID NOS:68 and 135), SERPINH1_13 (SEQ ID NOS: 69 and 136), SERPINH1_45 (SEQ ID NOS:97 and 164), SERPINH1_45a (SEQ ID NOS:98 and 165), SERPINH1_51 (SEQ ID NOS:101 and 168), SERPINH1_51a (SEQ ID NOS:105 and 172), SERPINH1_52 (SEQ ID NOS:102 and 169), and SERPINH1_86 (SEQ ID NOS:123 and 190).

In some preferred embodiments, the antisense and sense strands are selected from the sequence pairs set forth in SERPINH1_2 (SEQ ID NOS:60 and 127), SERPINH1_6 (SEQ ID NOS:63 and 130), SERPINH1_45a (SEQ ID NOS:98 and 165), SERPINH1_51 (SEQ ID NOS:101 and 168), and SERPINH1_51a (SEQ ID NOS:105 and 172).

In some preferred embodiments, the antisense and sense strands are selected from the sequence pairs set forth in SERPINH1_2 (SEQ ID NOS:60 and 127). In some embodiments, the antisense and sense strands are the sequence pairs set forth in SERPINH1_6 (SEQ ID NOS:63 and 130). In some embodiments, the antisense and sense strands are the sequence pairs set forth in SERPINH1_11 (SEQ ID NOS:68 and 135). In some embodiments, the antisense and sense strands are the sequence pairs set forth in SERPINH1_13 (SEQ ID NOS:69 and 136). In some embodiments, the antisense and sense strands are the sequence pairs set forth in SERPINH1_45 (SEQ ID NOS:97 and 164). In some embodiments, the antisense and sense strands are the sequence pairs set forth in SERPINH1_45a (SEQ ID NOS: 98 and 165). In some embodiments, the antisense and sense strands are the sequence pairs set forth in SERPINH1_51 (SEQ ID NOS:101 and 168). In some embodiments, the antisense and sense strands are the sequence pairs set forth in SERPINH1_51a (SEQ ID NOS:105 and 172). In some embodiments, the antisense and sense strands are the sequence pairs set forth in SERPINH1_52 (SEQ ID NOS: 102 and 169). In some embodiments the antisense and sense strands are the sequence pairs set forth in (SEQ ID NOS:123 and 190). In some preferred embodiments, the antisense and sense strands are selected from the sequence pairs set forth in SERPINH1_2 (SEQ ID NOS:60 and 127), SERPINH1_6 (SEQ ID NOS:63 and 130), SERPINH1_45a (SEQ ID NOS:98 and 165), SERPINH1_51 (SEQ ID NOS:101 and 168), and SERPINH1_51a (SEQ ID NOS:105 and 172).

In some embodiments, $N^1$ and $N^2$ form a Watson-Crick base pair. In other embodiments, $N^1$ and $N^2$ form a non-Watson-Crick base pair. In some embodiments $N^1$ is a modified riboadenosine or a modified ribouridine.

In some embodiments, $N^1$ and $N^2$ form a Watson-Crick base pair. In other embodiments, $N^1$ and $N^2$ form a non-Watson-Crick base pair. In certain embodiments, $N^1$ is selected from the group consisting of riboadenosine, modified riboadenosine, deoxyriboadenosine, modified deoxyriboadenosine. In other embodiments, $N^1$ is selected from the group consisting of ribouridine, deoxyribouridine, modified ribouridine, and modified deoxyribouridine.

In certain embodiments, position 1 in the antisense strand (5'-terminus) includes deoxyribouridine (dU) or adenosine. In some embodiments, $N^1$ is selected from the group consisting of riboadenosine, modified riboadenosine, deoxyriboadenosine, modified deoxyriboadenosine and $N^2$ is selected from the group consisting of ribouridine, deoxyribouridine, modified ribouridine, and modified deoxyribouridine. In certain embodiments, $N^1$ is selected from the group consisting of riboadenosine and modified riboadenosine and $N^2$ is selected from the group consisting of ribouridine and modified ribouridine.

In certain embodiments, $N^1$ is selected from the group consisting of ribouridine, deoxyribouridine, modified ribouridine, and modified deoxyribouridine and $N^2$ is selected from the group consisting of riboadenosine, modified riboadenosine, deoxyriboadenosine, and modified deoxyriboadenosine. In certain embodiments, $N^1$ is selected from the group consisting of ribouridine and deoxyribouridine and $N^2$ is selected from the group consisting of riboadenosine and modified riboadenosine. In certain embodiments, $N^1$ is ribouridine and $N^2$ is riboadenosine. In certain embodiments, $N^1$ is deoxyribouridine and $N^2$ is riboadenosine.

In some embodiments of Structure (A2), $N^1$ includes 2'OMe modified ribouracil or 2'OMe modified riboadenosine. In certain embodiments of structure (A2), $N^2$ includes a 2'OMe modified ribonucleotide or deoxyribonucleotide.

In some embodiments of Structure (A2), $N^1$ includes 2'OMe modified ribouracil or 2'OMe modified ribocytosine. In certain embodiments of structure (A2), $N^2$ includes a 2'OMe modified ribonucleotide.

In some embodiments each of N and N' is an unmodified nucleotide. In some embodiments, at least one of N or N' includes a chemically modified nucleotide or an unconventional moiety. In some embodiments, the unconventional moiety is selected from a mirror nucleotide, an abasic ribose moiety and an abasic deoxyribose moiety. In some embodiments, the unconventional moiety is a mirror nucleotide, preferably an L-DNA moiety. In some embodiments, at least one of N or N' includes a 2'OMe modified ribonucleotide.

In some embodiments, the sequence of $(N')_y$ is fully complementary to the sequence of $(N)_x$. In other embodiments, the sequence of $(N')_y$ is substantially complementary to the sequence of $(N)_x$.

In some embodiments, $(N)_x$ includes an antisense sequence that is fully complementary to about 17 to about 39 consecutive nt in a target mRNA. In other embodiments, $(N)_x$ includes an antisense that is substantially complementary to about 17 to about 39 consecutive nt in a target mRNA.

In some embodiments of Structure A1 and Structure A2 the compound is blunt ended, for example, wherein both Z and Z' are absent. In an alternative embodiment, at least one of Z or Z' is present. Z and Z' independently include one or more covalently linked modified and or unmodified nucleotides, including deoxyribonucleotides and ribonucleotides, or an unconventional moiety, for example, inverted abasic deoxyribose moiety or abasic ribose moiety; a non-nucleotide C3, C4 or C5 moiety, an amino-6 moiety, a mirror nucleotide, and the like. In some embodiments, each of Z and Z' independently includes a C3 moiety or an amino-C6 moiety. In some embodiments Z' is absent and Z is present and includes a non-nucleotide C3 moiety. In some embodiments Z is absent and Z' is present and includes a non-nucleotide C3 moiety.

In some embodiments of Structure A1 and Structure A2, each N consists of an unmodified ribonucleotide. In some embodiments of Structure A1 and Structure A2, each N' consists of an unmodified nucleotide. In preferred embodiments, at least one of N and N' is a modified ribonucleotide or an unconventional moiety.

In other embodiments, the compound of Structure A1 or Structure A2 includes at least one ribonucleotide modified in the sugar residue. In some embodiments, the compound includes a modification at the 2' position of the sugar residue. In some embodiments, the modification in the 2' position includes the presence of an amino, a fluoro, an alkoxy or an alkyl moiety. In certain embodiments, the 2' modification includes an alkoxy moiety. In preferred embodiments, the alkoxy moiety is a methoxy moiety (2'OMe). In some embodiments, the nucleic acid compound includes 2'OMe modified alternating ribonucleotides in one or both of the antisense and the sense strands. In other embodiments, the compound includes 2'OMe modified ribonucleotides in the antisense strand, $(N)_x$ or $N^1$—$(N)_x$, only. In certain embodiments, the middle ribonucleotide of the antisense strand, e.g., ribonucleotide in position 10 in a 19-mer strand is unmodified. In various embodiments, the nucleic acid compound includes at least 5 alternating 2'OMe modified and unmodified ribonucleotides. In additional embodiments, the compound of Structure A1 or Structure A2 includes modified ribonucleotides in alternating positions wherein each ribonucleotide at the 5' and 3'-termini of $(N)_x$ or $N^1$—$(N)_x$ are modified in their sugar residues, and each ribonucleotide at the 5' and 3'-termini of $(N')_y$ or $N^2$—$(N)_y$ are unmodified in their sugar residues.

In some embodiments, the double-stranded molecule as a component of a pharmaceutical formulation includes one or more of the following modifications N in at least one of positions 5, 6, 7, 8, or 9 of the antisense strand is selected from a 2'-5'-nucleotide or a mirror nucleotide;

N' in at least one of positions 9 or 10 of the sense strand is selected from a 2'-5'-nucleotide and a pseudo-uridine; and N' in 4, 5, or 6 consecutive positions at the 3'-terminus positions of $(N')_y$ comprises a 2'-5'-nucleotide.

In some embodiments, the double-stranded molecule includes a combination of the following modifications the antisense strand includes a 2'-5'-nucleotide or a mirror nucleotide in at least one of positions 5, 6, 7, 8, or 9; and the sense strand includes at least one of a 2'-5'-nucleotide and a pseudo-uridine in positions 9 or 10.

In some embodiments, the double-stranded molecule includes a combination of the following modifications the antisense strand includes a 2'-5'-nucleotide or a mirror nucleotide in at least one of positions 5, 6, 7, 8, or 9; and the sense strand includes 4, 5, or 6 consecutive 2'-5'-nucleotides at the 3'-penultimate or 3'-terminal positions.

In some embodiments, the sense strand $((N)_x$ or $N^1$—$(N)_x)$ includes 1, 2, 3, 4, 5, 6, 7, 8, or 9 2'OMe modified ribonucleotides. In some embodiments, the antisense strand includes 2'OMe modified ribonucleotides at positions 2, 4, 6, 8, 11, 13, 15, 17 and 19. In other embodiments, antisense strand includes 2'OMe modified ribonucleotides at positions 1, 3, 5, 7, 9, 11, 13, 15, 17 and 19. In other embodiments, the antisense strand includes 2'OMe modified ribonucleotides at positions 3, 5, 7, 9, 11, 13, 15, 17 and 19. In some embodiments the antisense strand includes one or more 2'OMe modified pyrimidines. In some embodiments, all the pyrimidine nucleotides in the antisense strand are 2'OMe modified. In some embodiments, the sense strand includes 2'OMe modified pyrimidines.

In some embodiments of Structure A1 and Structure A2, neither the sense strand nor the antisense strand is phosphorylated at the 3'- and 5'-termini. In other embodiments, one or both of the sense strand or the antisense strand are phosphorylated at the 3'-termini.

In some embodiments of Structure A1 and Structure A2, $(N)_y$ includes at least one unconventional moiety selected from a mirror nucleotide, a 2'-5'-nucleotide and a TNA. In some embodiments, the unconventional moiety is a mirror nucleotide. In various embodiments, the mirror nucleotide is selected from an L-ribonucleotide (L-RNA) and an L-deoxyribonucleotide (L-DNA). In preferred embodiments, the mirror nucleotide is L-DNA. In certain embodiments, the sense strand comprises an unconventional moiety in position 9 or 10 (from the 5'-terminus). In preferred embodiments, the sense strand includes an unconventional moiety in position 9 (from the 5'-terminus). In some embodiments, the sense strand is 19 nt in length and comprises 4, 5, or 6 consecutive unconventional moieties in positions 15, (from the 5'-terminus). In some embodiments, the sense strand includes 4 consecutive 2'-5'-ribonucleotides in positions 15, 16, 17, and 18. In some embodiments, the sense strand includes 5 consecutive 2'-5'-ribonucleotides in positions 15, 16, 17, 18 and 19. In various embodiments, the sense strand further comprises Z'. In some embodiments, Z' includes a C3OH moiety or a C3Pi moiety.

In some embodiments, of Structure A1 $(N')_y$ includes at least one L-DNA moiety. In some embodiments, $x=y=19$ and $(N')_y$ consists of unmodified ribonucleotides at positions 1-17 and 19 and one L-DNA at the 3' penultimate position (position 18). In other embodiments, $x=y=19$ and $(N')_y$ consists of unmodified ribonucleotides at positions 1-16 and 19 and two consecutive L-DNA at the 3' penultimate position (positions 17 and 18). In various embodiments, the unconventional moiety is a nucleotide joined to an adjacent nucleotide by a 2'-5' internucleotide phosphate linkage. According to various embodiments, $(N')_y$ includes 2, 3, 4, 5, or 6 consecutive ribonucleotides at the 3'-terminus linked by 2'-5' internucleotide linkages. In one embodiment, four consecutive nucleotides at the 3'-terminus of $(N)_y$ are joined by three 2'-5' phosphodiester bonds, wherein one or more of the 2'-5' nucleotides which form the 2'-5' phosphodiester bonds further includes a 3'-O-methyl (3'OMe) sugar modification. Preferably the 3'-terminal nucleotide of $(N)_y$ includes a 2'OMe modification. In certain embodiments, $x=y=19$ and $(N')_y$ includes two or more consecutive nucleotides at positions 15, 16, 17, 18 and 19 include a nucleotide joined to an adjacent nucleotide by a 2'-5' internucleotide bond (2'-5' nucleotide). In various embodiments the nucleotide forming the 2'-5' internucleotide bond includes a 3' deoxyribose nucleotide or a 3' methoxy nucleotide (3' H or 3'OMe in place of a 3' OH). In some embodiments $x=y=19$ and $(N')_y$ includes 2'-5' nucleotides at positions 15, 16 and 17 such that adjacent nucleotides are linked by a 2'-5' internucleotide bond between positions 15-16, 16-17 and 17-18; or at positions, 15, 16, 17, 18, and 19 such that adjacent nucleotides are linked by a 2'-5' internucleotide bond between positions 15-16, 16-17, 17-18 and 18-19 and a 3'OH is available at the 3'-terminal nucleotide or at positions 16, 17 and 18 such that adjacent nucleotides are linked by a 2'-5' internucleotide bond between positions 16-17, 17-18 and 18-19. In some embodiments x=y=19 and $(N')_y$ includes 2'-5'-nucleotides at positions 16 and 17 or at positions 17 and 18 or at positions 15 and 17 such that adjacent nucleotides are linked by a 2'-5' internucleotide bond between positions 16-17 and 17-18 or between positions 17-18 and 18-19 or between positions 15-16 and 17-18, respectively. In other embodiments, the pyrimidine ribonucleotides (rU, rC) in $(N')_y$ are substituted with nucleotides joined to the adjacent nucleotide by a 2'-5' internucleotide bond. In some embodiments, the antisense and sense strands are selected from the sequence pairs set forth in SERPINH1_4, SERPINH1_12, SERPINH1_18, SERPINH1_30, SERPINH1_58 or SERPINH1_88, and x=y=19 and $(N')_y$ comprises five consecutive nucleotides at the 3'-terminus joined by four 2'-5' linkages, specifically the linkages between the nucleotides position 15-16, 16-17, 17-18 and 18-19.

In some embodiments, the linkages include phosphodiester bonds. In some embodiments, the antisense and sense strands are selected from the sequence pairs set forth in SERPINH1_4, SERPINH1_12, SERPINH1_18, SERPINH1_30, SERPINH1_58 or SERPINH1_88 and x=y=19 and $(N')_y$ comprises five consecutive nt at the 3'-terminus joined by four 2'-5' linkages and optionally further includes Z' and z' independently selected from an inverted abasic moiety and a C3 alkyl (1,3-propanediol mono(dihydrogen phosphate)) cap. The C3 alkyl cap is covalently linked to the 3' or 5' terminal nucleotide. In some embodiments, the 3' C3 terminal cap further comprises a 3' phosphate. In some embodiments, the 3' C3 terminal cap further comprises a 3'-terminal hydroxy group.

In some embodiments, the antisense and sense strands as components of a pharmaceutical formulation are selected from the sequence pairs set forth in SERPINH1_4, SERPINH1_12, SERPINH1_18, SERPINH1_30, SERPINH1_58 or SERPINH1_88 and x=y=19 and $(N')_y$ includes an L-DNA position 18; and $(N')_y$ optionally further includes Z' and z' independently selected from an inverted abasic moiety and a C3 alkyl cap.

In some embodiments, $(N')_y$ includes a 3'-terminal phosphate. In some embodiments, $(N')_y$ includes a 3'-terminal hydroxyl.

In some embodiments, the antisense and sense strands as components of a pharmaceutical formulation are selected from the sequence pairs set forth in SERPINH1_4, SERPINH1_12, SERPINH1_18, SERPINH1_30, SERPINH1_58 or SERPINH1_88 and x=y=19 and $(N)_x$ includes 2'OMe modified ribonucleotides at positions 1, 3, 5, 7, 9, 11, 13, 15, 17, 19 or at positions 2, 4, 6, 8, 11, 13, 15, 17, 19. In some embodiments, the antisense and sense strands are selected from the sequence pairs set forth in SERPINH1_4, SERPINH1_12, SERPINH1_18, SERPINH1_30, SERPINH1_58 and SERPINH1_88 and x=y=19 and (N), includes 2'OMe modified pyrimidines. In some embodiments, all pyrimidines in $(N)_x$ include the 2'OMe modification.

In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPIN51a, SERPINH1_52 or SERPINH1_86 and x=y=18 and $N^2$ is a riboadenosine moiety.

In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPIN51a, SERPINH1_52 or SERPINH1_86 and x=y=18, and $N^2$—$(N)_y$ includes five consecutive nt at the 3'-terminus joined by four 2'-5' linkages, specifically the linkages between the nucleotides position 15-16, 16-17, 17-18 and 18-19. In some embodiments the linkages include phosphodiester bonds.

In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and $N^2$—$(N)_y$ includes five consecutive nt at the 3'-terminus joined by four 2'-5' linkages and optionally further includes Z' and z' independently selected from an inverted abasic moiety and a C3 alkyl [C3; 1,3-propanediol mono(dihydrogen phosphate)] cap.

In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and $N^2$—$(N)_y$ includes an L-DNA position 18; and $(N')_y$ optionally further includes Z' and z' independently selected from an inverted abasic moiety and a C3 alkyl [C3; 1,3-propanediol mono(dihydrogen phosphate)] cap.

In some embodiments, $N^2$—$(N')_y$ comprises a 3'-terminal phosphate. In some embodiments, $N^2$—$(N')_y$ comprises a 3'-terminal hydroxyl.

In some embodiments, the antisense and sense strands as components of a pharmaceutical formulation are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and N1-$(N)_x$ includes 2'OMe modified ribonucleotides in positions 1, 3, 5, 7, 9, 11, 13, 15, 17, 19 or in positions 1, 3, 5, 9, 11, 13, 15, 17, 19, or in positions 3, 5, 9, 11, 13, 15, 17, or in positions 2, 4, 6, 8, 11, 13, 15, 17, 19. In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_52 or SERPINH1_86 and x=y=18 and $N^1$—$(N)_x$ includes 2'OMe modified ribonucleotides at positions 11, 13, 15, 17 and 19. In some embodiments, the antisense and sense strands are selected from the sequence pairs set forth in SERPINH1_2, SERPINH1_6, SERPINH1_11, SERPINH1_13, SERPINH1-45, SERPINH1_45a, SERPINH1_51, SERPINH1_51a, SERPINH1_52 or SERPINH1_86 and x=y=18 and $N^1$—$(N)_x$ includes 2'OMe modified ribonucleotides in positions 1, 3, 5, 7, 9, 11, 13, 15, 17, 19 or in positions 3, 5, 7, 9, 11, 13, 15, 17, 19. In some embodiments, the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_52 or SERPINH1_86 and x=y=18 and $N^1$—$(N)_x$ includes 2'OMe modified ribonucleotides in positions 2, 4, 6, 8, 11, 13, 15, 17, 19.

In some embodiments, the antisense and sense strands as components of a pharmaceutical formulation are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and $N^1$—(N)' includes 2'OMe modified pyrimidines. In some embodiments, all pyrimidines in $(N)_x$ include the 2'OMe modification. In some embodiments, the antisense strand further includes an L-DNA or a 2'-5' nucleotide in position 5, 6 or 7. In other embodiments, the antisense strand further includes a ribonucleotide which generates a 2'-5' internucleotide linkage in between the ribonucleotides in positions 5-6 or 6-7.

In additional embodiments, $N^1$—$(N)_x$ further includes Z wherein Z includes a non-nucleotide overhang. In some embodiments the non-nucleotide overhang is C3-C3 [1,3-propanediol mono(dihydrogen phosphate)]2.

In some embodiments, of Structure A2, $(N)_y$ includes at least one L-DNA moiety. In some embodiments x=y=18 and $(N')_y$ consists of unmodified ribonucleotides at positions 1-16 and 18 and one L-DNA at the 3' penultimate position (position 17). In other embodiments, x=y=18 and $(N')_y$ consists of unmodified ribonucleotides at position 1-15 and 18 and two consecutive L-DNA at the 3' penultimate position (positions 16 and 17). In various embodiments, the unconventional moiety is a nucleotide joined to an adjacent nucleotide by a 2'-5' internucleotide phosphate linkage. According to various embodiments, $(N')_y$ includes 2, 3, 4, 5, or 6 consecutive ribonucleotides at the 3'-terminus linked by 2'-5' internucleotide linkages. In one embodiment, four consecutive nt at the 3'-terminus of $(N')_y$ are joined by three 2'-5' phosphodiester bonds, wherein one or more of the 2'-5' nucleotides which form the 2'-5' phosphodiester bonds further includes a 3'-O-methyl (3'OMe) sugar modification. Preferably, the 3'-terminal nucleotide of $(N')_y$ includes a 2'OMe modification. In certain embodiments, x=y=18 and in (N')y two or more consecutive nt at positions 14, 15, 16, 17, and 18 include a nucleotide joined to an adjacent nucleotide by a 2'-5' internucleotide bond. In various embodiments, the nucleotide forming the 2'-5' internucleotide bond includes a 3' deoxyribose nucleotide or a 3' methoxy nucleotide. In some embodiments, x=y=18 and $(N')_y$ includes nucleotides joined to the adjacent nucleotide by a 2'-5' internucleotide bond between positions 15-16, 16-17 and 17-18 or between positions 16-17 and 17-18. In some embodiments, x=y=18 and $(N')_y$ includes nucleotides joined to the adjacent nucleotide by a 2'-5' internucleotide bond between positions 14-15, 15-16, 16-17, and 17-18 or between positions 15-16, 16-17, and 17-18 or between positions 16-17 and 17-18 or between positions 17-18 or between positions 15-16 and 17-18. In other embodiments, the pyrimidine ribonucleotides (rU, rC) in $(N')_y$ are substituted with nucleotides joined to the adjacent nucleotide by a 2'-5' internucleotide bond.

In some embodiments, the antisense and sense strands are selected from the oligonucleotide pairs set forth in Table 5 and identified herein as SERPINH1_2 (SEQ ID NOS:60 and 127), SERPINH1_6 (SEQ ID NOS:63 and 130), SERPINH1_45a (SEQ ID NOS:98 and 165), SERPINH1_51 (SEQ ID NOS:101 and 168), and SERPINH1_51a (SEQ ID NOS:105 and 172).

In some embodiments, the double-stranded nucleic acid molecule as a component of a pharmaceutical formulation includes the antisense strand set forth in SEQ ID NO:127 and sense strand set forth in SEQ ID NO:60; identified herein as SERPINH1_2. In some embodiments the double-stranded nucleic acid molecule has the structure

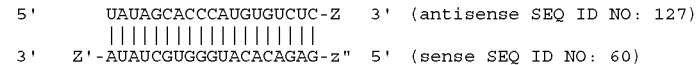

```
5'    UAUAGCACCCAUGUGUCUC-Z    3'  (antisense SEQ ID NO: 127)
      ||||||||||||||||||
3'   Z'-AUAUCGUGGGUACACAGAG-z"  5'  (sense SEQ ID NO: 60)
``` wherein each "|" represents base pairing between the ribonucleotides; wherein each of A, C, G, U is independently an unmodified or modified ribonucleotide, or an unconventional moiety;

wherein each of Z and Z' is independently present or absent, but if present is independently 1-5 consecutive nt or non-nucleotide moieties or a combination thereof covalently attached at the 3'-terminus of the strand in which it is present; and wherein z" may be present or absent, but if present is a capping moiety covalently attached at the 5'-terminus of $N^2$—$(N')_y$.

In some embodiments, provided is a double-stranded nucleic acid molecule wherein the antisense strand (SEQ ID NO:127) includes one or more 2'OMe modified pyrimidines and or purines, a 2'-5'-ribonucleotide in position 5, 6, 7 or 8, and a 3'-terminal nucleotide or non-nucleotide overhang. In some embodiments, the sense strand (SEQ ID NO:60) includes 4 or 5 consecutive 2'-5'-nucleotides at the 3'-terminal or penultimate positions, a nucleotide or non-nucleotide moiety covalently attached at the 3'-terminus and a cap moiety covalently attached at the 5'-terminus. In other embodiments, the sense strand (SEQ ID NO:60) includes one or more 2'OMe pyrimidine, a nucleotide or non-nucleotide moiety covalently attached at the 3'-terminus and a cap moiety covalently attached at the 5'-terminus.

In some embodiments, provided is a double-stranded nucleic acid molecule wherein the antisense strand (SEQ ID NO:127) includes 2'OMe modified ribonucleotides at positions 1, 3, 5, 9, 11, 15, 17 and 19; a 2'-5'-ribonucleotide at position 7; and a C3Pi-C3OH moiety covalently attached to the 3'-terminus; and the sense strand (SEQ ID NO:60) is selected from a sense strand which includes 2'-5'-ribonucleotides at positions 15, 16, 17, 18 and 19; a C3OH 3'-terminal non-nucleotide overhang; and an inverted abasic deoxyribonucleotide moiety covalently attached at the 5'-terminus; or 2'-5'-ribonucleotides at positions 15, 16, 17, 18 and 19; a 3'-terminal phosphate; and an inverted abasic deoxyribonucleotide moiety covalently attached at the 5'-terminus; or 2'OMe modified ribonucleotides at positions 5, 7, 13, and 16; a 2'-5'-ribonucleotide at position 18; a C3-OH moiety covalently attached at the 3'-terminus; and an inverted abasic deoxyribonucleotide moiety covalently attached at the 5'-terminus; or 2'OMe modified ribonucleotides at positions 7, 13, 16 and 18; a 2'-5'-ribonucleotide at position 9; a C3OH moiety covalently attached at the 3'-terminus; and an inverted abasic deoxyribonucleotide moiety covalently attached at the 5'-terminus; or 2'-5'-ribonucleotides at positions 15, 16, 17, 18, and 19; a C3-Pi moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:127) includes 2'OMe modified ribonucleotides at positions 1, 3, 5, 9, 11, 15, 17, 19; a 2'-5'-ribonucleotide at position 7; and a C3Pi-C3OH moiety covalently attached to the 3'-terminus; and the sense strand (SEQ ID NO:60) includes 2'-5'-ribonucleotides at positions 15, 16, 17, 18, and 19; a C3 3'-terminal overhang; and an inverted abasic deoxyribonucleotide moiety covalently attached at the 5'-terminus.

Provided herein is a double-stranded nucleic acid molecule wherein the antisense strand (SEQ ID NO:127) includes 2'OMe modified ribonucleotides at positions 1, 3, 5, 9, 11, 15, 17, 19; a 2'-5'-ribonucleotide at position 7; and a C3Pi-C3OH 3'-terminal overhang; and the sense strand (SEQ ID NO:60) includes 2'-5'-ribonucleotides at positions 15, 16, 17, 18, and 19; a 3'-terminal phosphate; and an inverted abasic deoxyribonucleotide moiety covalently attached at the 5'-terminus.

Provided herein is a double-stranded nucleic acid molecule wherein the antisense strand (SEQ ID NO:127) includes 2'OMe modified ribonucleotides at positions 1, 3, 5, 9, 11, 15, 17, 19; a 2'-5'-ribonucleotide at position 7 and a C3Pi-C3OH moiety covalently attached to the 3'-terminus; and the sense strand (SEQ ID NO:60) includes 2'OMe modified ribonucleotides at positions 5, 7, 13, and 16; a 2'-5'-ribonucleotide at position 18; a C3-OH moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:127) includes 2'OMe modified ribonucleotides at positions 1, 3, 5, 9, 11, 15, 17, 19; a 2'-5'-ribonucleotide at position 7 and a C3Pi-C3OH moiety covalently attached to the 3'-terminus; and the sense strand (SEQ ID NO:60) includes 2'OMe modified ribonucleotides at positions 7, 13, 16 and 18; a 2'-5'-ribonucleotide at position 9; a C3-OH moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:127) includes 2'OMe modified ribonucleotides at positions 1, 3, 5, 9, 11, 15, 17, 19; a 2'-5'-ribonucleotide at position 7; and a C3Pi-C3OH moiety covalently attached to the 3'-terminus; and the sense strand (SEQ ID NO:60) includes 2'-5'-ribonucleotides at positions 15, 16, 17, 18, and 19; a C3-Pi moiety covalently attached at the 3'-terminus; and an inverted abasic deoxyribonucleotide moiety covalently attached at the 5'-terminus.

In some embodiments provided herein is a double-stranded nucleic acid molecule wherein the antisense strand (SEQ ID NO:127) includes 2'OMe modified ribonucleotides at positions 1, 3, 5, 9, 11, 13, 15, 17, 19; and a C3-C3 3'-terminal overhang; and the sense strand (SEQ ID NO:60) includes 2'OMe modified ribonucleotides at positions 7, 9, 13, 16 and 18; and an inverted abasic deoxyribonucleotide moiety covalently attached at the 5'-terminus.

In some embodiments provided herein is a double-stranded nucleic acid molecule wherein the sense strand (SEQ ID NO:60) includes 2'-5'-ribonucleotides at positions 15, 16, 17, 18, and 19; a 3'-terminal phosphate; and an inverted abasic deoxyribonucleotide moiety covalently attached at the 5'-terminus; and the antisense strand (SEQ ID NO:127) includes an antisense strand selected from one of
  2'OMe modified ribonucleotides at positions 1, 3, 5, 7, 9, 11, 13, 15, 17, 19; and a C3Pi-C3OH moiety covalently attached to the 3'-terminus; or
  2'OMe modified ribonucleotides at positions 1, 3, 6, 8, 10, 12, 14, 17, 18; and a C3Pi-C3OH moiety covalently attached to the 3'-terminus.

In some embodiments provided herein is a double-stranded nucleic acid molecule as a component of a pharmaceutical formulation which includes the antisense strand set forth in SEQ ID NO:130 and the sense strand set forth in SEQ ID NO:63; identified herein as SERPINH1_6. In some embodiments the duplex comprises the structure

```
5'    UACUCGUCUCGCAUCUUGU-Z    3'   (antisense SEQ ID NO: 130)
      ||||||||||||||||||
3'    Z'-AUGAGCAGAGCGUAGAACA-z"   5' (sense SEQ ID NO: 63)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3'-terminus of the strand in which it is present; and
wherein z" may be present or absent, but if present is a capping moiety covalently attached at the 5'-terminus of $N^2$—$(N')_y$.

In some embodiments provided herein is a double-stranded nucleic acid molecule wherein the sense strand (SEQ ID NO:63) includes one or more 2'OMe modified pyrimidines; a 3'-terminal nucleotide or non-nucleotide overhang; and cap moiety covalently attached at the 5'-terminus. In some embodiments, the antisense strand (SEQ ID NO:130) includes one or more 2'OMe modified pyrimidine; a nucleotide or non-nucleotide moiety covalently attached at the 3'-terminus; and a cap moiety covalently attached at the 5'-terminus.

In some embodiments provided herein is a double-stranded nucleic acid molecule wherein the sense strand (SEQ ID NO:63) includes 2'OMe modified ribonucleotides at positions 2, 14 and 18; a C3OH or C3Pi moiety covalently attached at the 3'-terminus; and an inverted abasic deoxyribonucleotide moiety covalently attached at the 5'-terminus; and the antisense strand (SEQ ID NO:130) is selected from an antisense strand that includes
  2'OMe modified ribonucleotides in positions 1, 3, 5, 9, 11, 13, 15 and 17; a 2'-5'-ribonucleotide at position 7; and a C3Pi-C3OH moiety covalently attached to the 3'-terminus; or
  2'OMe modified ribonucleotides in positions 1, 3, 5, 7, 9, 12, 13 and 17; a 2'-5'-ribonucleotide at position 7; and a C3Pi-C3OH moiety covalently attached to the 3'-terminus; or
  2'OMe modified ribonucleotides in positions 3, 5, 9, 11, 13, 15 and 17; a 2'-5'-ribonucleotide at position 7; and a C3Pi-C3OH moiety covalently attached to the 3'-terminus; or
  2'OMe modified ribonucleotides in positions 3, 5, 9, 11, 13, 15 and 17; a dU in position 1; a 2'-5'-ribonucleotide in position 7; and a C3Pi-C3OH moiety covalently attached to the 3'-terminus.

In some embodiments provided herein is a double-stranded nucleic acid molecule wherein the sense strand (SEQ ID NO:63) includes 2'OMe modified ribonucleotides in positions 2, 14 and 18; a C3-OH moiety covalently attached at the 3'-terminus; and an inverted abasic deoxyribonucleotide moiety covalently attached at the 5'-terminus; and the antisense strand (SEQ ID NO:130) includes 2'OMe modified ribonucleotides in positions 1, 3, 5, 9, 11, 13, 15 and 17; a 2'-5'-ribonucleotide in position 7; and a C3Pi-C3OH moiety covalently attached to the 3'-terminus.

In some embodiments provided herein is a duplex oligonucleotide molecule wherein the sense strand (SEQ ID NO:63) includes 2'OMe modified ribonucleotides in positions 14 and 18 and optionally in position 2; a C3-OH moiety covalently attached at the 3'-terminus; and an inverted abasic deoxyribonucleotide moiety covalently attached at the 5'-terminus; and the antisense strand (SEQ ID NO:130) includes 2'OMe modified ribonucleotides in positions 1, 3, 5, 7, 9, 12, 13, and 17; a 2'-5'-ribonucleotide at position 7; and a C3Pi-C3OH moiety covalently attached to the 3'-terminus.

In some embodiments provided herein is a duplex oligonucleotide molecule wherein the sense strand (SEQ ID NO:63) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:130) is selected from an antisense strand which includes 2'OMe modified ribonucleotides in positions 1, 3, 5, 9, 11, 13, 15 and 17; a 2'-5'-ribonucleotide in position 7; and a C3Pi-C3Pi or C3Pi-C3OH moiety covalently attached to the 3'-terminus; or 2'OMe modified ribonucleotides in positions 1, 3, 5, 7, 9, 12, 13, and 17; a 2'-5'-ribonucleotide in position 7; and a C3Pi-C3Pi or C3Pi-C3OH moiety covalently attached to the 3'-terminus.

Provided herein is a double-stranded nucleic acid molecule wherein the sense strand (SEQ ID NO:63) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:130) includes 2'OMe modified ribonucleotides in positions 1, 3, 5, 9, 11, 13, 15 and 17; a 2'-5'-ribonucleotide in position 7; and a C3Pi-C3OH moiety covalently attached to the 3'-terminus.

Provided herein is a double-stranded nucleic acid molecule wherein the sense strand (SEQ ID NO:63) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:130) includes 2'OMe modified ribonucleotides in positions 1, 3, 5, 7, 9, 12, 13, and 17; a 2'-5'-ribonucleotide in position 7; and a C3Pi-C3OH 3'-terminal overhang.

In some embodiments, the duplex s a component of a pharmaceutical formulation includes the antisense strand set forth in SEQ ID NO:165 and sense strand set forth in SEQ ID NO:98; identified herein as SERPINH1_45a. In some embodiments, the duplex comprises the structure wherein each "|" represents base pairing between the ribonucleotides;

wherein each of A, C, G, U is independently an unmodified or modified ribonucleotide, or an unconventional moiety;

wherein each of Z and Z' is independently present or absent, but if present is independently 1-5 consecutive nucleotides or non-nucleotide moieties or a combination thereof covalently attached at the 3'-terminus of the strand in which it is present; and wherein z" may be present or absent, but if present is a capping moiety covalently attached at the 5'-terminus of $N^2$—$(N')_y$.

In some embodiments, the sense strand (SEQ ID NO:98) includes 2'-5'-ribonucleotides in positions 15, 16, 17, and 18 or 15, 16, 17, 18, and 19; a nucleotide or non-nucleotide moiety covalently attached at the 3'-terminus; and a cap moiety covalently attached at the 5'-terminus. In some embodiments the antisense strand (SEQ ID NO:165) includes 2'OMe modified pyrimidine and or purines; a 2'-5' nucleotide in position 5, 6, 7, or 8; and a nucleotide or non-nucleotide moiety covalently attached at the 3'-terminus.

In some embodiments, the sense strand (SEQ ID NO:98) includes 2'-5'-ribonucleotides in positions 15, 16, 17, 18, and 19; a C3Pi or C3-OH 3'-terminal non-nucleotide moiety; and an inverted abasic deoxyribonucleotide moiety covalently attached at the 5'-terminus; and the antisense strand (SEQ ID NO:165) includes an antisense strand selected from one of 2'OMe modified ribonucleotides in positions 2, 4, 6, 8, 11, 13, 15, 17, and 19; a 2'-5'-ribonucleotide in position 7; and a C3Pi-C3Pi or C3Pi-C3OH 3'-terminal overhang; or 2'OMe modified ribonucleotides in positions 2, 4, 6, 8, 11, 13, 15, 17 and 19; and a C3Pi-C3Pi or C3Pi-C3OH 3'-terminal overhang;

2'OMe modified ribonucleotides in positions 1, 3, 5, 9, 11, 13, 15, 17, and 19; a 2'-5'-ribonucleotide in position 7; and a C3Pi-C3Pi or C3Pi-C3OH 3'-terminal overhang; or 2'OMe modified ribonucleotides in positions 1, 3, 5, 7, 9, 11, 13, 15, 17 and 19; and a C3Pi-C3Pi or C3Pi-C3OH 3'-terminal overhang.

Provided herein is a double-stranded nucleic acid molecule wherein the sense strand (SEQ ID NO:98) includes 2'-5'-ribonucleotides in positions 15, 16, 17, 18, and 19; a C3-OH 3'-terminal moiety; and an inverted abasic deoxyribonucleotide moiety covalently attached at the 5'-terminus; and the antisense strand (SEQ ID NO:165) includes 2'OMe modified ribonucleotides in positions 2, 4, 6, 8, 11, 13, 15, 17, and 19; a 2'-5'-ribonucleotide in position 7; and a C3Pi-COH 3'-terminal overhang.

In some embodiments, the double-stranded nucleic acid molecule s a component of a pharmaceutical formulation includes the antisense strand set forth in SEQ ID NO:168 and sense strand set forth in SEQ ID NO:101; identified herein as SERPINH1_51. In some embodiments, the duplex comprises the structure

```
5'     AGGAAGUUGAUCUUGGAGU-Z    3'  (antisense SEQ ID NO: 165)
       ||||||||||||||||||
3'  Z'-UCCUUCAACUAGAACCUCA-z"   5'  (sense SEQ ID NO: 98)
```

```
5'    UCACCCAUGUGUCUCAGGA-Z    3'  (antisense SEQ ID NO: 168)
      ||||||||||||||||||
3'   Z'-AGUGGGUACACAGAGUCCU-z"  5' (sense SEQ ID NO: 101)
``` wherein each "|" represents base pairing between the ribonucleotides;

wherein each of A, C, G, U is independently an unmodified or modified ribonucleotide, or an unconventional moiety;

wherein each of Z and Z' is independently present or absent, but if present is independently 1-5 consecutive nucleotides or non-nucleotide moieties or a combination thereof covalently attached at the 3'-terminus of the strand in which it is present; and wherein z" may be present or absent, but if present is a capping moiety covalently attached at the 5'-terminus of $N^2$—$(N')_y$.

In some embodiments provided herein is a double-stranded nucleic acid molecule wherein the sense strand (SEQ ID NO:101) includes 2'OMe modified pyrimidines, optionally a 2'-5'-ribonucleotide in position 9 or 10; a nucleotide or non-nucleotide moiety covalently attached at the 3'-terminus; and optionally a cap moiety covalently attached at the 5'-terminus. In some embodiments the antisense strand (SEQ ID NO:168) includes 2'OMe modified pyrimidine and or purines; a 2'-5' nucleotide in position 5, 6, 7, or 8; and a nucleotide or non-nucleotide moiety covalently attached at the 3'-terminus.

In some embodiments provided herein is a double-stranded nucleic acid molecule wherein the sense strand (SEQ ID NO:101) includes 2'OMe modified pyrimidines in positions 4, 11, 13, and 17; optionally a 2'-5'-ribonucleotide in position 9 or 10; a C3Pi or C3OH non-nucleotide moiety covalently attached at the 3'-terminus; and an inverted abasic deoxyribonucleotide moiety covalently attached at the 5'-terminus; and the antisense strand (SEQ ID NO:168) is selected from an antisense strand which includes a) 2'OMe modified ribonucleotides in positions 1, 8, and 15; a 2'-5'-ribonucleotide in position 6 or 7; and a C3Pi-C3OH overhang covalently attached at the 3'-terminus; or b) 2'OMe modified ribonucleotides in positions 1, 4, 8, 13 and 15; a 2'-5'-ribonucleotide in position 6 or 7; and a C3Pi-C3OH overhang covalently attached at the 3'-terminus; or c) 2'OMe modified ribonucleotides in positions 1, 4, 8, 11 and 15; a 2'-5'-ribonucleotide in position 6; and a C3Pi-C3OH overhang covalently attached at the 3'-terminus; or d) 2'OMe modified ribonucleotides in positions 1, 3, 8, 12, 13, and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:101) includes 2'OMe modified ribonucleotides in positions 4, 11, 13, and 17; optionally a 2'-5'-ribonucleotide in position 9; a C3-OH non-nucleotide moiety covalently attached at the 3'-terminus; and an inverted abasic deoxyribonucleotide moiety covalently attached at the 5'-terminus; and the antisense strand (SEQ ID NO:168) includes 2'OMe modified ribonucleotides in positions 1, 8, and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:101) includes 2'OMe modified ribonucleotides in positions 4, 11, 13, and 17; optionally a 2'-5'-ribonucleotide in position 9; a C3-OH non-nucleotide moiety covalently attached at the 3'-terminus; and an inverted abasic deoxyribonucleotide moiety covalently attached at the 5'-terminus; and the antisense strand (SEQ ID NO:168) includes 2'OMe modified ribonucleotides in positions 1, 4, 8, 13 and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:101) includes 2'OMe modified ribonucleotides in positions 4, 11, 13, and 17; a 2'-5'-ribonucleotide in position 9; a C3OH non-nucleotide moiety covalently attached at the 3'-terminus; and an inverted abasic deoxyribonucleotide moiety covalently attached at the 5'-terminus; and the antisense strand (SEQ ID NO:168) includes 2'OMe modified ribonucleotides in positions 1, 4, 8, 11 and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:101) includes 2'OMe modified ribonucleotides in positions 4, 11, 13, and 17; a 2'-5'-ribonucleotide in position 9; a C3OH non-nucleotide moiety covalently attached at the 3'-terminus; and an inverted abasic deoxyribonucleotide moiety covalently attached at the 5'-terminus; and the antisense strand (SEQ ID NO:168) includes 2'OMe modified ribonucleotides in positions 1, 3, 8, 12, 13, and 15; a 2'-5'-ribonucleotide in position 6; and a C3Pi-C3OH moiety covalently attached at the 3'-terminus.

In some embodiments, the double-stranded nucleic acid molecule is a component of a pharmaceutical formulation includes the antisense strand set forth in SEQ ID NO:168 and sense strand set forth in SEQ ID NO:101; identified herein as SERPINH1_51a. In some embodiments the duplex comprises the structure

```
5'    ACACCCAUGUGUCUCAGGA-Z    3'  (antisense SEQ ID NO: 172)
      ||||||||||||||||||
3'   Z'-UGUGGGUACACAGAGUCCU-z"  5' (sense SEQ ID NO: 105)
``` wherein each "|" represents base pairing between the ribonucleotides; wherein each of A, C, G, U is independently an unmodified or modified ribonucleotide, or an unconventional moiety;

wherein each of Z and Z' is independently present or absent, but if present is independently 1-5 consecutive nucleotides or non-nucleotide moieties or a combination thereof covalently attached at the 3'-terminus of the strand in which it is present; and wherein z" may be present or absent, but if present is a capping moiety covalently attached at the 5'-terminus of $N^2$—$(N')_y$.

In some embodiments provided herein is a double-stranded nucleic acid molecule wherein the sense strand (SEQ ID NO:105) includes 2'OMe modified pyrimidines; optionally a 2'-5'-ribonucleotide in position 9 or 10; a nucleotide or non-nucleotide moiety covalently attached at the 3'-terminus; and optionally a cap moiety covalently attached at the 5'-terminus. In some embodiments the antisense strand (SEQ ID NO:172) includes 2'OMe modified pyrimidine and or purines; a 2'-5' nucleotide in position 5, 6, 7, or 8; and a nucleotide or non-nucleotide moiety covalently attached at the 3'-terminus.

In some embodiments provided herein is a double-stranded nucleic acid molecule wherein the sense strand (SEQ ID NO:105) includes 2'OMe modified pyrimidines in positions 4, 11, 13, and 17; optionally a 2'-5'-ribonucleotide in position 9 or 10; a C3Pi or C3OH non-nucleotide moiety covalently attached at the 3'-terminus; and an inverted abasic deoxyribonucleotide moiety covalently attached at the 5'-terminus; and the antisense strand (SEQ ID NO:172) is selected from an antisense strand which includes a) 2'OMe modified ribonucleotides in positions 8, and 15; a 2'-5'-ribonucleotide in position 6 or 7; and a C3Pi-C3OH moiety covalently attached at the 3'-terminus; or b) 2'OMe modified ribonucleotides in positions 4, 8, 13 and 15; a 2'-5'-ribonucleotide in position 6 or 7; and a C3Pi-C3OH moiety covalently attached at the 3'-terminus; or c) 2'OMe modified ribonucleotides in positions 4, 8, 11 and 15; a 2'-5'-ribonucleotide in position 6; and a C3Pi-C3OH moiety covalently attached at the 3'-terminus; or d) 2'OMe modified ribonucleotides in positions 3, 8, 12, 13, and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:105) includes 2'OMe modified ribonucleotides in positions 4, 11, 13, and 17; optionally a 2'-5'-ribonucleotide in position 9; a C3-OH non-nucleotide moiety covalently attached at the 3'-terminus; and an inverted abasic deoxyribonucleotide moiety covalently attached at the 5'-terminus; and the antisense strand (SEQ ID NO:172) includes 2'OMe modified ribonucleotides in positions 8 and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:105) includes 2'OMe modified ribonucleotides in positions 4, 11, 13, and 17; optionally a 2'-5'-ribonucleotide in position 9; a C3-OH non-nucleotide moiety covalently attached at the 3'-terminus; and an inverted abasic deoxyribonucleotide moiety covalently attached at the 5'-terminus; and the antisense strand (SEQ ID NO:172) includes 2'OMe modified ribonucleotides in positions 4, 8, 13 and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:105) includes 2'OMe modified ribonucleotides in positions 4, 11, 13, and 17; a 2'-5'-ribonucleotide in position 9; a C3-OH non-nucleotide moiety covalently attached at the 3'-terminus; and an inverted abasic deoxyribonucleotide moiety covalently attached at the 5'-terminus; and the antisense strand (SEQ ID NO:172) includes 2'OMe modified ribonucleotides in positions 4, 8, 11 and 15; a 2'-5'-ribonucleotide in position 6; and a C3Pi-C3OH moiety covalently attached at the 3'-terminus.

Provided herein is a double-stranded nucleic acid molecule wherein the sense strand (SEQ ID NO:105) includes 2'OMe modified ribonucleotides in positions 4, 11, 13, and 17; a 2'-5'-ribonucleotide in position 9; a C3OH non-nucleotide moiety covalently attached at the 3'-terminus; and an inverted abasic deoxyribonucleotide moiety covalently attached at the 5'-terminus; and the antisense strand (SEQ ID NO:172) includes 2'OMe modified ribonucleotides in positions 3, 8, 12, 13, and 15; a 2'-5'-ribonucleotide in position 6; and a C3Pi-C3OH moiety covalently attached at the 3'-terminus.

In some embodiments, the antisense and sense strands are selected from the oligonucleotide pairs set forth in Table 5 and identified herein as SERPINH1_4 (SEQ ID NOS:195 and 220) and SERPINH1_12 (SEQ ID NOS:196 and 221).

In some embodiments, the double-stranded nucleic acid molecule is a component of a pharmaceutical formulation includes the antisense strand set forth in SEQ ID NO:220 and sense strand set forth in SEQ ID NO:195; identified herein as SERPINH1_4. In some embodiments, the double-stranded nucleic acid molecule has the structure

```
5'    AAUAGCACCCAUGUGUCUC-Z    3'  (antisense SEQ ID NO: 220)
      ||||||||||||||||||
3'   Z'-UUAUCGUGGGUACACAGAG-z"  5'  (sense SEQ ID NO: 195)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3'-terminus of the strand in which it is present; and
wherein z" may be present or absent, but if present is a capping moiety covalently attached at the 5'-terminus of $N^2$—$(N')_y$.

In some embodiments provided is a double-stranded nucleic acid molecule wherein the antisense strand (SEQ ID NO:220) includes 2'OMe modified ribonucleotides in positions 3, 5, 9, 11, 15, 17 and 19, a 2'-5'-ribonucleotide in position 7, and a C3Pi-C3OH moiety covalently attached to the 3'-terminus; and the sense strand (SEQ ID NO:195) is selected from a sense strand which includes a) 2'-5'-ribonucleotides in positions 15, 16, 17, 18 and 19, a C3OH moiety covalently attached to the 3'-terminus; and an inverted abasic deoxyribonucleotide moiety covalently attached at the 5'-terminus; or b) 2'-5'-ribonucleotides in positions 15, 16, 17, 18 and 19, a 3'-terminal phosphate; and an inverted abasic deoxyribonucleotide moiety covalently attached at the 5'-terminus; or c) 2'OMe modified ribonucleotides in positions 5, 7, 13, and 16; a 2'-5'-ribonucleotide in position 18; a C3OH moiety covalently attached at the 3'-terminus; and an inverted abasic deoxyribonucleotide moiety covalently attached at the 5'-terminus; or d) 2'OMe modified ribonucleotides in positions 7, 13, 16 and 18; a 2'-5'-ribonucleotide in position 9; a C3OH moiety covalently attached at the 3'-terminus; and an inverted abasic deoxyribonucleotide moiety covalently attached at the 5'-terminus; or e) 2'-5'-ribonucleotides in positions 15, 16, 17, 18, and 19; a C3Pi moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:220) includes 2'OMe modified ribonucleotides in positions 3, 5, 9, 11, 15, 17, 19; a 2'-5'-ribonucleotide in position 7; and a C3Pi-C3OH moiety covalently attached to the 3'-terminus; and the sense strand (SEQ ID NO:195) includes 2'-5'-ribonucleotides in positions 15, 16, 17, 18, and 19; a C3 moiety covalently attached to the 3'-terminus; and an inverted abasic deoxyribonucleotide moiety covalently attached at the 5'-terminus.

Provided herein is a double-stranded nucleic acid molecule wherein the antisense strand (SEQ ID NO:220) includes 2'OMe modified ribonucleotides in positions 3, 5, 9, 11, 15, 17, 19; a 2'-5'-ribonucleotide in position 7; and a C3Pi-C3OH moiety covalently attached to the 3'-terminus; and the sense strand (SEQ ID NO:195) includes 2'-5'-ribonucleotides in positions 15, 16, 17, 18, and 19; a 3'-terminal phosphate; and an inverted abasic deoxyribonucleotide moiety covalently attached at the 5'-terminus.

Provided herein is a double-stranded nucleic acid molecule wherein the antisense strand (SEQ ID NO:220) includes 2'OMe modified ribonucleotides in positions 3, 5, 9, 11, 15, 17, 19; a 2'-5'-ribonucleotide in position 7; and a C3Pi-C3OH moiety covalently attached to the 3'-terminus; and the sense strand (SEQ ID NO:195) includes 2'OMe modified ribonucleotides in positions 5, 7, 13, and 16; a 2'-5'-ribonucleotide in position 18; a C3OH moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:220) includes 2'OMe modified ribonucleotides in positions 3, 5, 9, 11, 15, 17, 19; a 2'-5'-ribonucleotide in position 7; and a C3Pi-C3OH moiety covalently attached to the 3'-terminus; and the sense strand (SEQ ID NO:195) includes 2'OMe modified ribonucleotides in positions 7, 13, 16 and 18; a 2'-5'-ribonucleotide in position 9; a C3OH moiety covalently attached at the 3'-terminus; and an inverted abasic deoxyribonucleotide moiety covalently attached at the 5'-terminus.

Provided herein is a double-stranded nucleic acid molecule wherein the antisense strand (SEQ ID NO:220) includes 2'OMe modified ribonucleotides in positions 3, 5, 9, 11, 15, 17, 19; a 2'-5'-ribonucleotide in position 7; and a C3Pi-C3OH moiety covalently attached to the 3'-terminus; and the sense strand (SEQ ID NO:195) includes 2'-5'-ribonucleotides in positions 15, 16, 17, 18, and 19; a C3Pi moiety covalently attached at the 3'-terminus; and an inverted abasic deoxyribonucleotide moiety covalently attached at the 5'-terminus.

In some embodiments provided herein is a double-stranded nucleic acid molecule wherein the antisense strand (SEQ ID NO:220) includes 2'OMe modified ribonucleotides in positions 1, 3, 5, 9, 11, 13, 15, 17, 19; and a C3Pi-C3OH moiety covalently attached to the 3'-terminus; and the sense strand (SEQ ID NO:195) includes 2'OMe modified ribonucleotides in positions 7, 9, 13, 16 and 18; and an inverted abasic deoxyribonucleotide moiety covalently attached at the 5'-terminus.

In some embodiments provided herein is a double-stranded nucleic acid molecule wherein the sense strand (SEQ ID NO:195) includes 2'-5'-ribonucleotides in positions 15, 16, 17, 18, and 19; a 3'-terminal phosphate and an inverted abasic deoxyribonucleotide moiety covalently attached at the 5'-terminus; and the antisense strand (SEQ ID NO:220) includes an antisense strand selected from one of a) 2'OMe modified ribonucleotides in positions 3, 5, 7, 9, 11, 13, 15, 17, 19; and a C3Pi-C3OH moiety covalently attached to the 3'-terminus; or b) 2'OMe modified ribonucleotides in positions 1, 3, 6, 8, 10, 12, 14, 17, 18; and a C3Pi-C3OH moiety covalently attached to the 3'-terminus.

In some embodiments, provided is a double-stranded nucleic acid molecule is a component of a pharmaceutical formulation which includes the antisense strand set forth in SEQ ID NO:130 and the sense strand set forth in SEQ ID NO:63; identified herein as SERPINH1_12. In some embodiments the duplex comprises the structure

```
5'    AACUCGUCUCGCAUCUUGU-Z    3'  (antisense SEQ ID NO: 221)
      ||||||||||||||||||
3'  Z'-UUGAGCAGAGCGUAGAACA-z"  5'  (sense SEQ ID NO: 196)
``` wherein each "|" represents base pairing between the ribonucleotides;

wherein each of A, C, G, U is independently an unmodified or modified ribonucleotide, or an unconventional moiety;

wherein each of Z and Z' is independently present or absent, but if present is independently 1-5 consecutive nucleotides or non-nucleotide moieties or a combination thereof covalently attached at the 3'-terminus of the strand in which it is present; and wherein z" may be present or absent, but if present is a capping moiety covalently attached at the 5'-terminus of $N^2—(N')_y$.

In some embodiments, provided is a double-stranded nucleic acid molecule wherein the sense strand (SEQ ID NO:196) includes one or more 2'OMe modified pyrimidines; a 3'-terminal nucleotide or non-nucleotide overhang; and a cap moiety covalently attached at the 5'-terminus. In some embodiments, the antisense strand (SEQ ID NO:221) includes one or more 2'OMe modified pyrimidines; a nucleotide or non-nucleotide moiety covalently attached at the 3'-terminus; and a cap moiety covalently attached at the 5'-terminus.

In some embodiments provided is a double-stranded nucleic acid molecule wherein the sense strand (SEQ ID NO:196) includes 2'OMe modified ribonucleotides in positions 2, 14 and 18; a C3OH moiety covalently attached at the 3'-terminus; and an inverted abasic deoxyribonucleotide moiety covalently attached at the 5'-terminus; and the antisense strand (SEQ ID NO:221) is selected from an antisense strand which includes a) 2'OMe modified ribonucleotides in positions 3, 5, 9, 11, 13, 15 and 17; a 2'-5'-ribonucleotide in position 7; and a C3Pi-C3OH moiety covalently attached to the 3'-terminus; or b) 2'OMe modified ribonucleotides in positions 3, 5, 7, 9, 12, 13 and 17; a 2'-5'-ribonucleotide in position 7; and a C3Pi-C3OH moiety covalently attached to the 3'-terminus.

In some embodiments provided is a double-stranded nucleic acid molecule wherein the sense strand (SEQ ID NO:196) includes 2'OMe modified ribonucleotides in positions 2, 14 and 18; a C3-OH moiety covalently attached at the 3'-terminus; and an inverted abasic deoxyribonucleotide moiety covalently attached at the 5'-terminus; and the antisense strand (SEQ ID NO:221) includes 2'OMe modified ribonucleotides in positions 3, 5, 9, 11, 13, 15 and 17; a 2'-5'-ribonucleotide in position 7; and a C3Pi-C3OH moiety covalently attached to the 3'-terminus.

In some embodiments provided is a duplex oligonucleotide molecule wherein the sense strand (SEQ ID NO:196) includes 2'OMe modified ribonucleotides in positions 14 and 18 and optionally in position 2; a C3-OH moiety covalently attached at the 3'-terminus; and an inverted abasic deoxyribonucleotide moiety covalently attached at the 5'-terminus; and the antisense strand (SEQ ID NO:221) includes 2'OMe modified ribonucleotides in positions 3, 5, 7, 9, 12, 13, and 17; a 2'-5'-ribonucleotide in position 7; and a C3Pi-C3OH moiety covalently attached to the 3'-terminus.

In some embodiments provided is a duplex oligonucleotide molecule wherein the sense strand (SEQ ID NO:196) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:221) is selected from an antisense strand which includes
a) 2'OMe modified ribonucleotides in positions 3, 5, 9, 11, 13, 15 and 17; a 2'-5'-ribonucleotide in position 7; and a C3Pi-C3OH moiety covalently attached to the 3'-terminus; or
b) 2'OMe modified ribonucleotides in positions 3, 5, 7, 9, 12, 13 and 17; a 2'-5'-ribonucleotide in position 7; and a C3Pi-C3OH moiety covalently attached to the 3'-terminus.

Provided herein is a double-stranded nucleic acid molecule wherein the sense strand (SEQ ID NO:196) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:221) includes 2'OMe modified ribonucleotides in positions 1, 3, 5, 9, 11, 13, 15 and 17; a 2'-5'-ribonucleotide in position 7; and a C3Pi-C3OH moiety covalently attached to the 3'-terminus.

Provided herein is a double-stranded nucleic acid molecule wherein the sense strand (SEQ ID NO:196) includes 2'OMe modified ribonucleotides in positions 14 and 18; a C3-OH moiety covalently attached at the 3'-terminus; and an inverted abasic deoxyribonucleotide moiety covalently attached at the 5'-terminus; and the antisense strand (SEQ ID NO:221) includes 2'OMe modified ribonucleotides in positions 1, 3, 5, 7, 9, 12, 13, and 17; a 2'-5'-ribonucleotide in position 7; and a C3Pi-C3OH moiety covalently attached to the 3'-terminus.

In further embodiments of Structures A1 and A2, (N')y includes 1-8 modified ribonucleotides wherein the modified ribonucleotide is a DNA nucleotide. In certain embodiments (N')y includes 1, 2, 3, 4, 5, 6, 7, or up to 8 DNA moieties.

In some embodiments, either Z or Z' is present and independently includes two non-nucleotide moieties.

In additional embodiments, Z and Z' are present and each independently includes two non-nucleotide moieties.

In some embodiments, each of Z and Z' includes an abasic moiety, for example a deoxyribo-abasic moiety (referred to herein as "dAb") or ribo-abasic moiety (referred to herein as "rAb"). In some embodiments each of Z and/or Z' includes two covalently linked abasic moieties and is for example dAb-dAb or rAb-rAb or dAb-rAb or rAb-dAb, wherein each moiety is covalently attached to an adjacent moiety, preferably via a phospho-based bond. In some embodiments, the phospho-based bond includes a phosphorothioate, a phosphonoacetate or a phosphodiester bond. In preferred embodiments, the phospho-based bond includes a phosphodiester bond.

In some embodiments, each of Z and/or Z' independently includes an alkyl moiety, optionally propane $((CH_2)_3)$ moiety ("C3") or a derivative thereof including propanediol (C3OH) and phospho derivative of propanediol ("C3Pi"). In some embodiments, each of Z and/or Z' includes two alkyl moieties covalently linked to the 3'-terminus of the antisense strand or sense strand via a phosphodiester or phosphorothioate linkage and covalently linked to one another via a phosphodiester or phosphorothioate linkage and in some examples is C3Pi-C3Pi or C3Pi-C3OH. The 3'-terminus of the antisense strand and/or the 3'-terminus of the sense strand is covalently attached to a C3 moiety via a phospho-based bond and the C3 moiety is covalently conjugated to a C3OH moiety via a phospho-based bond. In some embodiments the phospho-based bonds include a phosphorothioate, a phosphonoacetate or a phosphodiester bond. In preferred embodiments, the phospho-based bond includes a phosphodiester bond.

In various embodiments of Structure A1 or Structure A2, Z and Z' are absent. In other embodiments Z or Z' is present. In some embodiments, each of Z and/or Z' independently includes a C2, C3, C4, C5 or C6 alkyl moiety, optionally a C3 moiety or a derivative thereof including propanol (C3OH/C3OH), propanediol, and phosphodiester derivative of propanediol (C3Pi). In preferred embodiments, each of Z and/or Z' includes two hydrocarbon moieties and in some examples is C3Pi-C3OH or C3Pi-C3Pi. Each C3 is covalently conjugated to an adjacent C3 via a covalent bond, preferably a phospho-based bond. In some embodiments, the phospho-based bond is a phosphorothioate, a phosphonoacetate or a phosphodiester bond.

In specific embodiments, x=y=19 and Z comprises at least one C3 alkyl overhang. In some embodiments the C3-C3 overhang is covalently attached to the 3'-terminus of $(N)_x$ or $(N')_y$ via a covalent linkage, preferably a phosphodiester linkage. In some embodiments, the linkage between a first C3 and a second C3 is a phosphodiester linkage. In some embodiments, the 3' non-nucleotide overhang is C3Pi-C3Pi. In some embodiments the 3' non-nucleotide overhang is C3Pi-C3Pi. In some embodiments, the 3' non-nucleotide overhang is C3Pi-C3OH.

In various embodiments, the alkyl moiety comprises an alkyl derivative including a C3 alkyl, C4 alkyl, C5 alky or C6 alkyl moiety comprising a terminal hydroxyl, a terminal amino, or terminal phosphate group. In some embodiments, the alkyl moiety is a C3 alkyl or C3 alkyl derivative moiety. In some embodiments, the C3 alkyl moiety comprises propanol, propyl phosphate, propyl phosphorothioate or a combination thereof. The C3 alkyl moiety is covalently linked to the 3'-terminus of $(N')_y$ and/or the 3'-terminus of $(N)_x$ via a phosphodiester bond. In some embodiments, the alkyl moiety comprises propanol, propyl phosphate, or propyl phosphorothioate. In some embodiments, each of Z and Z' is independently selected from propanol, propyl phosphate, propyl phosphorothioate, combinations thereof, or multiples thereof, in particular 2 or 3 covalently linked propanol, propyl phosphate, propyl phosphorothioate, or combinations thereof. In some embodiments, each of Z and Z' is independently selected from propyl phosphate, propyl phosphorothioate, propyl phospho-propanol; propyl phospho-propyl phosphorothioate; propyl phospho-propyl phosphate; (propyl phosphate)$_3$, (propyl phosphate)$_2$-propanol, (propyl phosphate)$_2$-propyl phosphorothioate. Any propane or propanol conjugated moiety can be included in Z or Z'.

The structures of exemplary 3'-terminal non-nucleotide moieties are as follows:

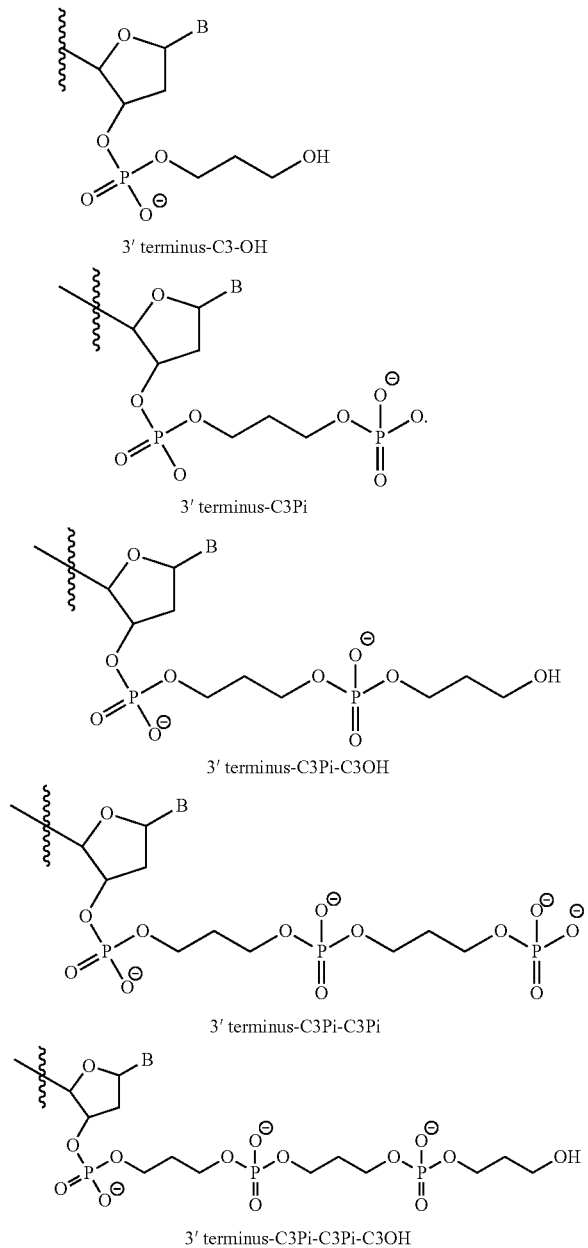

3' terminus-C3-OH

3' terminus-C3Pi

3' terminus-C3Pi-C3OH

3' terminus-C3Pi-C3Pi

3' terminus-C3Pi-C3Pi-C3OH

In some embodiments, each of Z and Z' is independently selected from propanol, propyl phosphate, propyl phosphorothioate, combinations thereof or multiples thereof.

In some embodiments, each of Z and Z' is independently selected from propyl phosphate, propyl phosphorothioate, propyl phospho-propanol; propyl phospho-propyl phosphorothioate; propylphospho-propyl phosphate; (propyl phosphate)$_3$, (propyl phosphate)$_2$-propanol, (propyl phosphate) $_2$-propyl phosphorothioate. Any propane or propanol conjugated moiety can be included in Z or Z'.

In additional embodiments, each of Z and/or Z' includes a combination of an abasic moiety and an unmodified deoxyribonucleotide or ribonucleotide or a combination of a hydrocarbon moiety and an unmodified deoxyribonucleotide or ribonucleotide or a combination of an abasic moiety (deoxyribo or ribo) and a hydrocarbon moiety. In such embodiments, each of Z and/or Z' includes C3-rAb or C3-dAb wherein each moiety is covalently bond to the adjacent moiety via a phospho-based bond, preferably a phosphodiester, phosphorothioate or phosphonoacetate bond.

In certain embodiments, nucleic acid molecules as disclosed herein include a sense oligonucleotide sequence selected from any one of oligonucleotide having a sequence selected from SEQ ID NOS:60-126 and 194-218.

In certain preferred embodiments, compounds provided include Compound_1, Compound_2, Compound_3, Compound_4, Compound_5, Compound_6, Compound_7, Compound_8, and Compound_9, described infra.

In some embodiments, (such as, for example, Compound_1, Compound_5, and Compound_6) provided are 19-mer double-stranded nucleic acid molecules wherein the antisense strand is SEQ ID NO:127 and the sense strand is SEQ ID NO:60. In certain embodiments, provided are 19-mer double-stranded nucleic acid molecules wherein the antisense strand is SEQ ID NO:127 and includes 2'OMe modified ribonucleotides; a 2'-5'-ribonucleotide in at least one of positions 1, 5, 6, or 7; and a non-nucleotide moiety covalently attached to the 3'-terminus; and the sense strand is SEQ ID NO:60 and includes at least one 2'-5'-ribonucleotide or 2'OMe modified ribonucleotide; a non-nucleotide moiety covalently attached at the 3'-terminus; and a cap moiety covalently attached at the 5'-terminus. In some embodiments, provided are 19-mer double-stranded nucleic acid molecule wherein the antisense strand is SEQ ID NO:127; and includes 2'OMe modified ribonucleotides at positions 3, 5, 9, 11, 13, 15, 17, and 19; a 2'-5'-ribonucleotide in position 7; and a C3OH non-nucleotide moiety covalently attached at the 3'-terminus; and the sense strand is SEQ ID NO:60 and includes five consecutive 2'-5'-ribonucleotides in the 3'-terminal positions 15, 16, 17, 18, and 19; a C3Pi non-nucleotide moiety covalently attached at the 3'-terminus; and an inverted abasic moiety covalently attached at the 5'-terminus.

In one embodiment, provided is Compound_1 that is a 19-mer double-stranded nucleic acid molecule wherein the antisense strand is SEQ ID NO:127 and includes 2'OMe modified ribonucleotides at positions 3, 5, 9, 11, 13, 15, 17, and 19; a 2'-5'-ribonucleotide in position 7; and a C3Pi-C3OH non-nucleotide moiety covalently attached at the 3'-terminus; and the sense strand is SEQ ID NO:60 and includes five consecutive 2'-5'-ribonucleotides in the 3'-terminal positions 15, 16, 17, 18, and 19; a C3Pi non-nucleotide moiety covalently attached at the 3'-terminus; and an inverted abasic moiety covalently attached at the 5'-terminus; and that further includes a 2'OMe modified ribonucleotide at position 1 of the antisense strand.

In one embodiment, provided is Compound_6 that is a 19-mer double-stranded nucleic acid molecule wherein the antisense strand is SEQ ID NO:127 and includes 2'OMe modified ribonucleotides at positions 3, 5, 9, 11, 13, 15, 17, and 19; a 2'-5'-ribonucleotide in position 7; and a C3Pi-C3OH non-nucleotide moiety covalently attached at the 3'-terminus; and the sense strand is SEQ ID NO:60 and includes five consecutive 2'-5'-ribonucleotides in the 3'-terminal positions 15, 16, 17, 18, and 19; a C3Pi non-nucleotide moiety covalently attached at the 3'-terminus; and an inverted abasic moiety covalently attached at the 5'-terminus; and that further includes a 2'-5'-ribonucleotide at position 1 of the antisense strand.

In one embodiment, provided is Compound_5 that is a 19-mer double-stranded nucleic acid molecule wherein the antisense strand is SEQ ID NO:127 and includes 2'OMe modified ribonucleotides in positions 1, 3, 5, 9, 11, 13, 15, 17, and 19; a 2'-5'-ribonucleotide in position 7; and a C3Pi-C3OH non-nucleotide moiety covalently attached at the 3'-terminus; and the sense strand is SEQ ID NO:60 and includes 2'OMe modified ribonucleotides in positions 7, 13, 16 and 18; a 2'-5'-ribonucleotide at position 9; a C3OH non-nucleotide moiety covalently attached at the 3'-terminus; and an inverted abasic moiety covalently attached at the 5'-terminus.

In some embodiments, (such as, for example, Compound_2, and Compound_7, described infra) provided are 19-mer double-stranded nucleic acid molecules wherein the sense strand is SEQ ID NO:63 and the antisense strand is SEQ ID NO:130. In some embodiments provided are 19-mer double-stranded nucleic acid molecules wherein the sense strand is SEQ ID NO:63 and includes 2'OMe modified pyrimidine ribonucleotides; a non-nucleotide moiety covalently attached at the 3'-terminus; and a cap moiety covalently attached at the 5'-terminus; and the antisense strand is SEQ ID NO:130 and includes 2'OMe modified ribonucleotides; a 2'-5'-ribonucleotide at position 7; and a non-nucleotide moiety covalently attached at the 3'-terminus. In some embodiments provided are 19-mer double-stranded nucleic acid molecules wherein the sense strand is SEQ ID NO:63 and includes 2'OMe modified ribonucleotides; a non-nucleotide moiety covalently attached at the 3'-terminus; and a cap moiety covalently attached at the 5'-terminus; and the antisense strand is SEQ ID NO:130 and includes 2'OMe modified ribonucleotides; a 2'-5'-ribonucleotide in at least one of positions 5, 6 or 7; and a non-nucleotide moiety covalently attached at the 3'-terminus.

In one embodiment, provided is Compound_2 that is a 19-mer double-stranded nucleic acid molecule wherein the sense strand is SEQ ID NO:63 and includes 2'OMe modified ribonucleotides in positions 2, 14 and 18; a C3OH moiety covalently attached at the 3'-terminus; and an inverted abasic deoxyribonucleotide moiety covalently attached at the 5'-terminus; and the antisense strand is SEQ ID NO:130 and includes 2'OMe modified ribonucleotides in positions 1, 3, 5, 9, 12, 13, and 17; a 2'-5'-ribonucleotide in at least one of positions 5, 6 or 7; and C3Pi-C3OH non-nucleotide moiety covalently attached at the 3'-terminus.

In one embodiment, provided is Compound_7 that is a 19-mer double-stranded nucleic acid molecule wherein the sense strand is SEQ ID NO:63 and includes 2'OMe modified ribonucleotides in positions 2, 14 and 18; a C3OH moiety covalently attached at the 3'-terminus; and an inverted abasic deoxyribonucleotide moiety covalently attached at the 5'-terminus; and the antisense strand is SEQ ID NO:130 and includes 2'OMe modified ribonucleotides in positions 1, 3, 5, 9, 11, 13, and 17; a 2'-5'-ribonucleotide at position 7; and a C3Pi-C3OH non-nucleotide moiety covalently attached at the 3'-terminus.

In some embodiments, (such as, for example, Compound_3, described infra) provided are 19-mer double-stranded nucleic acid molecules wherein the sense strand is SEQ ID NO:98 and the antisense strand is SEQ ID NO:165. In some embodiments, provided are 19-mer double-stranded nucleic acid molecules wherein the sense strand is SEQ ID NO:98 and includes 2'-5'-ribonucleotides in positions at the 3'-terminus; a non-nucleotide moiety covalently attached at the 3'-terminus; and a cap moiety covalently attached at the 5'-terminus; and the antisense strand is SEQ ID NO:165 and includes 2'OMe modified ribonucleotides; a 2'-5'-ribonucleotide in at least one of positions 5, 6 or 7; and a non-nucleotide moiety covalently attached at the 3'-terminus. In one embodiment, provided is Compound_3 that is a 19-mer double-stranded nucleic acid molecule wherein the sense strand is SEQ ID NO:98 and includes 2'-5'-ribonucleotides in positions 15, 16, 17, 18, and 19; a C3-OH 3' moiety covalently attached at the 3'-terminus; and an inverted abasic deoxyribonucleotide moiety covalently attached at the 5'-terminus; and the antisense strand is SEQ ID NO:165 and includes 2'OMe modified ribonucleotides in positions 2, 4, 6, 8, 11, 13, 15, 17, and 19; a 2'-5'-ribonucleotide in position 7; and a C3Pi-C3OH covalently attached at the 3'-terminus.

In some embodiments, (such as, for example, Compound_4, Compound_8 and Compound_9, described infra) provided are 19-mer double-stranded nucleic acid molecules wherein the sense strand is SEQ ID NO:101 and the antisense strand is SEQ ID NO:168. In some embodiments provided are 19-mer double-stranded nucleic acid molecules wherein the sense strand is SEQ ID NO:101 and includes 2'OMe modified pyrimidine ribonucleotides; an optional 2'-5'-ribonucleotide in one of position 9 or 10; a non-nucleotide moiety covalently attached at the 3'-terminus; and a cap moiety covalently attached at the 5'-terminus; and the antisense strand is SEQ ID NO:168 and includes 2'OMe modified ribonucleotides; a 2'-5'-ribonucleotide in at least one of positions 5, 6, or 7; and a non-nucleotide moiety covalently attached at the 3'-terminus.

In one embodiment, provided is Compound_4 that is a 19-mer double-stranded nucleic acid molecule wherein sense strand is SEQ ID NO:101 and includes 2'OMe modified ribonucleotides in positions 4, 11, 13, and 17; a 2'-5'-ribonucleotide in position 9; a C3OH non-nucleotide moiety covalently attached at the 3'-terminus; and an inverted abasic deoxyribonucleotide moiety covalently attached at the 5'-terminus; and the antisense strand is SEQ ID NO:168 and includes 2'OMe modified ribonucleotides in positions 1, 4, 8, 11 and 15; a 2'-5'-ribonucleotide in position 6; a C3Pi-C3OH overhang covalently attached at the 3'-terminus.

In one embodiment, provided is Compound_8 that is a 19-mer double-stranded nucleic acid molecule wherein sense strand is SEQ ID NO:101 and includes 2'OMe modified ribonucleotides in positions 4, 11, 13, and 17; a C3OH non-nucleotide moiety covalently attached at the 3'-terminus; and an inverted abasic deoxyribonucleotide moiety covalently attached at the 5'-terminus; and the antisense strand is SEQ ID NO:168 and includes 2'OMe modified ribonucleotides in positions 1, 4, 8, 13 and 15; a 2'-5'-ribonucleotide in position 6; and a C3Pi-C3OH overhang covalently attached at the 3'-terminus.

In one embodiment, provided is Compound_9 that is a 19-mer double-stranded nucleic acid molecule wherein the sense strand is SEQ ID NO:101 and includes 2'OMe modified ribonucleotides in positions 2, 4, 11, 13, and 17; a C3OH non-nucleotide moiety covalently attached at the 3'-terminus; and an inverted abasic deoxyribonucleotide moiety covalently attached at the 5'-terminus; and the antisense strand is SEQ ID NO:168 and includes 2'OMe modified ribonucleotides in positions 1, 4, 8, 11 and 15; a 2'-5'-ribonucleotide in position 6; and a C3Pi-C3OH moiety covalently attached at the 3'-terminus.

In one aspect, provided are pharmaceutical compositions that include a nucleic acid molecule (e.g., a siNA molecule) as described herein in a pharmaceutically acceptable carrier. In certain embodiments, the pharmaceutical formulation includes, or involves, a delivery system suitable for delivering nucleic acid molecules (e.g., siNA molecules) to an individual such as a patient; for example delivery systems described in more detail below.

In a related aspect, provided are compositions or kits that include a nucleic acid molecule (e.g., an siNA molecule) packaged for use by a patient. The package may be labeled or include a package label or insert that indicates the content of the package and provides certain information regarding how the nucleic acid molecule (e.g., an siNA molecule) should be or can be used by a patient, for example the label may include dosing information and/or indications for use. In certain embodiments, the contents of the label will bear a notice in a form prescribed by a government agency, for example the United States Food and Drug administration (FDA). In certain embodiments, the label may indicate that the nucleic acid molecule (e.g., an siNA molecule) is suitable for use in treating a patient suffering from a disease associated with hsp47; for example, the label may indicate that the nucleic acid molecule (e.g., an siNA molecule) is suitable for use in treating fibroids; or for example the label may indicate that the nucleic acid molecule (e.g., an siNA molecule) is suitable for use in treating a disease selected from the group consisting of fibrosis, liver fibrosis, cirrhosis, pulmonary fibrosis, kidney fibrosis, peritoneal fibrosis, chronic hepatic damage, and fibrillogenesis.

RNA Interference and siNA Nucleic Acid Molecules

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The presence of dsRNA in cells triggers the RNAi response through a mechanism that has yet to be fully characterized.

Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, Nature, 409, 363). siRNAs derived from dicer activity can be about 21 to about 23 nt in length and include about 19 base pair duplexes (Zamore et al., 2000, Cell, 101, 25-33; Elbashir et al., 2001, Genes Dev., 15, 188). Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, Genes Dev., 15, 188).

RNAi has been studied in a variety of systems, including C. elegans (Fire et al., 1998, Nature, 391, 806) and mammalian systems (Bahramian and Zarbl, 1999, Molecular and Cellular Biology, 19, 274-283, Wianny and Goetz, 1999, Nature Cell Biol., 2, 70), e.g., human embryonic kidney and HeLa cells (Elbashir et al., 2001, Nature, 411, 494 and Tuschl et al., WO0175164). Requirements for siRNA length, structure, chemical composition, and sequence that are essential to mediate efficient RNAi activity are known to those of ordinary skill in the art (Elbashir et al., 2001, EMBO J., 20, 6877 and Tuschl et al., WO0175164).

Nucleic acid molecules (for example comprising structural features as disclosed herein) may inhibit or down regulate gene expression or viral replication by mediating RNA interference "RNAi" or gene silencing in a sequence-specific manner (See, e.g., Zamore et al., 2000, Cell, 101, 25-33; Bass, 2001, Nature, 411, 428-429; Elbashir et al., 2001, Nature, 411, 494-498; and Kreutzer et al., WO0044895; Zernicka-Goetz et al., WO0136646; Fire, WO9932619; Plaetinck et al., WO0001846; Mello and Fire, WO0129058; Deschamps-Depaillette, WO9907409; and Li et al., WO0044914; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237; Hutvagner and Zamore, 2002, Science, 297, 2056-60; McManus et al., 2002, RNA, 8, 842-850; Reinhart et al., 2002, Gene & Dev., 16, 1616-1626; and Reinhart & Bartel, 2002, Science, 297, 1831).

An siNA nucleic acid molecule can be assembled from two separate polynucleotide strands, where one strand is the sense strand and the other is the antisense strand in which the antisense and sense strands are self-complementary (i.e., each strand includes nucleotide sequence that is complementary to nucleotide sequence in the other strand); such as where the antisense strand and sense strand form a duplex or double-stranded structure having any length and structure as described herein for nucleic acid molecules as provided, for example wherein the double-stranded region (duplex region) is about 15 to about 49 (e.g., about 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs); the antisense strand includes nucleotide sequence that is complementary to nucleotide sequence in a target nucleic acid molecule (i.e., hsp47 mRNA) or a portion thereof and the sense strand includes nucleotide sequence corresponding to the target nucleic acid sequence or a portion thereof (e.g., about 17 to about 49 or more nt of the nucleic acid molecules herein are complementary to the target nucleic acid or a portion thereof).

In certain aspects and embodiments, a nucleic acid molecule (e.g., a siNA molecule) provided herein may be a "RISC length" molecule or may be a Dicer substrate as described in more detail below.

An siNA nucleic acid molecule may include separate sense and antisense sequences or regions, where the sense and antisense regions are covalently linked by nucleotide or non-nucleotide linkers molecules as is known in the art, or are alternately non-covalently linked by ionic interactions, hydrogen bonding, van der Waals interactions, hydrophobic interactions, and/or stacking interactions. Nucleic acid molecules may include a nucleotide sequence that is complementary to nucleotide sequence of a target gene. Nucleic acid molecules may interact with nucleotide sequence of a target gene in a manner that causes inhibition of expression of the target gene.

Alternatively, an siNA nucleic acid molecule is assembled from a single polynucleotide, where the self-complementary sense and antisense regions of the nucleic acid molecules are linked by means of a nucleic acid based or non-nucleic acid-based linker(s), i.e., the antisense strand and the sense strand are part of one single polynucleotide that having an antisense region and sense region that fold to form a duplex region (for example to form a "hairpin" structure as is well known in the art). Such siNA nucleic acid molecules can be a polynucleotide with a duplex, asymmetric duplex, hairpin or asymmetric hairpin secondary structure, having self-complementary sense and antisense regions, wherein the antisense region includes nucleotide sequence that is complementary to nucleotide sequence in a separate target nucleic acid molecule or a portion thereof and the sense region having nucleotide sequence corresponding to the target nucleic acid sequence (e.g., a sequence of hsp47 mRNA). Such siNA nucleic acid molecules can be a circular single-stranded polynucleotide having two or more loop structures and a stem comprising self-complementary sense and antisense regions, wherein the antisense region includes nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active nucleic acid molecule capable of mediating RNAi.

The following nomenclature is often used in the art to describe lengths and overhangs of siNA molecules and may be used throughout the specification and Examples. In all descriptions of oligonucleotides herein, the identification of nucleotides in a sequence is given in the 5' to 3' direction for both sense and antisense strands. Names given to duplexes indicate the length of the oligomers and the presence or absence of overhangs. For example, a "21+2" duplex contains two nucleic acid strands both of which are 21 nt in length, also termed a 21-mer siRNA duplex or a 21-mer nucleic acid and having a 2 nt 3'-overhang. A "21-2" design refers to a 21-mer nucleic acid duplex with a 2 nt 5'-overhang. A 21-0 design is a 21-mer nucleic acid duplex with no overhangs (blunt). A "21+2UU" is a 21-mer duplex with 2-nt 3'-overhang and the terminal 2 nucleotides at the 3'-ends are both U residues (which may result in mismatch with target sequence). The aforementioned nomenclature can be applied to siNA molecules of various lengths of strands, duplexes and overhangs (such as 19-0, 21+2, 27+2, and the like). In an alternative but similar nomenclature, a "25/27" is an asymmetric duplex having a 25 base sense strand and a 27 base antisense strand with a 2-nucleotides 3'-overhang. A "27/25" is an asymmetric duplex having a 27 base sense strand and a 25 base antisense strand.

Chemical Modifications

In certain aspects and embodiments, nucleic acid molecules (e.g., siNA molecules) as provided herein include one or more modifications (or chemical modifications). In certain embodiments, such modifications include any changes to a nucleic acid molecule or polynucleotide that would make the molecule different than a standard ribonucleotide or RNA molecule (i.e., that includes standard adenosine, cytosine, uracil, or guanosine moieties); which may be referred to as an "unmodified" ribonucleotide or unmodified ribonucleic acid. Traditional DNA bases and polynucleotides having a 2'-deoxy sugar represented by adenosine, cytosine, thymine, or guanosine moieties may be referred to as an "unmodified deoxyribonucleotide" or "unmodified deoxyribonucleic acid"; accordingly, the term "unmodified nucleotide" or "unmodified nucleic acid" as used herein refers to an "unmodified ribonucleotide" or "unmodified ribonucleic acid" unless there is a clear indication to the contrary. Such modifications can be in the nucleotide sugar, nucleotide base, nucleotide phosphate group and/or the phosphate backbone of a polynucleotide.

In certain embodiments, modifications as disclosed herein may be used to increase RNAi activity of a molecule and/or to increase the in vivo stability of the molecules, particularly the stability in serum, and/or to increase bioavailability of the molecules. Non-limiting examples of modifications include internucleotide or internucleoside linkages; deoxynucleotides or dideoxyribonucleotides at any position and strand of the nucleic acid molecule; nucleic acid (e.g., ribonucleic acid) with a modification at the 2'-position preferably selected from an amino, fluoro, methoxy, alkoxy and alkyl; 2'-deoxyribonucleotides, 2'OMe ribonucleotides, 2'-deoxy-2'-fluoro ribonucleotides, "universal base" nucleotides, "acyclic" nucleotides, 5-C-methyl nucleotides, biotin group, and terminal glyceryl and/or inverted deoxy abasic residue incorporation, sterically hindered molecules, such as fluorescent molecules and the like. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dide-oxythymidine (d4T). Further details on various modifications are described in more detail below.

Modified nucleotides include those having a Northern conformation (e.g., Northern pseudorotation cycle, see for example Sanger, Principles of Nucleic Acid Structure, Springer-Verlag ed., 1984). Non-limiting examples of nucleotides having a northern configuration include LNA nucleotides (e.g., 2'-O, 4'-C-methylene-(D-ribofuranosyl) nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, and 2'OMe nucleotides. LNAs are described, for example, in Elman et al., 2005; Kurreck et al., 2002; Crinelli et al., 2002; Braasch and Corey, 2001; Bondensgaard et al., 2000; Wahlestedt et al., 2000; and WO0047599, WO9914226, WO9839352, and WO04083430. In one embodiment, an LNA is incorporated at the 5'-terminus of the sense strand.

Chemical modifications also include UNAs, which are non-nucleotide, acyclic analogues, in which the C2'-C3' bond is not present (although UNAs are not truly nucleotides, they are expressly included in the scope of "modified" nucleotides or modified nucleic acids as contemplated herein). In particular embodiments, nucleic acid molecules with an overhang may be modified to have UNAs at the overhang positions (i.e., 2 nucleotide overhang). In other embodiments, UNAs are included at the 3'- or 5'-ends. A UNA may be located anywhere along a nucleic acid strand, e.g., at position 7. Nucleic acid molecules may contain one or more UNA. In certain embodiments, nucleic acid molecules (e.g., siNA molecules) as described herein, include one or more UNAs; or one UNA. Exemplary UNAs are disclosed in Nucleic Acids Symposium Series No. 52 p. 133-134 (2008). In some embodiments, a nucleic acid molecule (e.g., a siNA molecule) as described herein that has a 3'-overhang include one or two UNAs in the 3' overhang. In some embodiments, a nucleic acid molecule (e.g., a siNA molecule) as described herein includes a UNA (for example one UNA) in the antisense strand; for example in position 6 or position 7 of the antisense strand. Chemical modifications also include non-pairing nucleotide analogs, for example as disclosed herein. Chemical modifications further include unconventional moieties as disclosed herein.

Chemical modifications also include terminal modifications on the 5' and/or 3' part of the oligonucleotides and are also known as capping moieties. Such terminal modifications are selected from a nucleotide, a modified nucleotide, a lipid, a peptide, and a sugar.

Chemical modifications also include six membered "six membered ring nucleotide analogs." Examples of six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides include 6-membered ring nucleotide analogs including hexitol and altritol nucleotide monomers are disclosed in WO2006047842.

Chemical modifications also include "mirror" nucleotides which have a reversed chirality as compared to normal naturally occurring nucleotide; that is, a mirror nucleotide may be an "L-nucleotide" analogue of naturally occurring D-nucleotide (see U.S. Pat. No. 6,602,858). Mirror nucleotides may further include at least one sugar or base modification and/or a backbone modification, for example, such as a phosphorothioate or phosphonate moiety, and nucleic acid catalysts including at least one L-nucleotide substitution. Mirror nucleotides include for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

In some embodiments, modified ribonucleotides include modified deoxyribonucleotides, for example 5'OMe DNA (5-methyl-deoxyriboguanosine-3'-phosphate) which may be useful as a nucleotide in the 5' terminal position (position number 1); PACE (deoxyriboadenosine 3' phosphonoacetate, deoxyribocytidine 3' phosphonoacetate, deoxyriboguanosine 3' phosphonoacetate, deoxyribothymidine 3' phosphonoacetate).

Modifications may be present in one or more strands of a nucleic acid molecule disclosed herein, e.g., in the sense strand, the antisense strand, or both strands. In certain embodiments, the antisense strand may include modifications and the sense strand my only include unmodified RNA.

Nucleobases

Nucleobases of the nucleic acid disclosed herein may include unmodified ribonucleotides (purines and pyrimidines) such as adenine, guanine, cytosine, and uracil. The nucleobases in one or both strands can be modified with natural and synthetic nucleobases such as, thymine, xanthine, hypoxanthine, inosine, 2-aminoadenine, 6-methyl and other alkyl derivatives of adenine and guanine, any "universal base" nucleotides; 2-propyl and other alkyl derivatives of adenine and guanine, 5-halo uracil and cytosine, 5-propynyl uracil and cytosine, 6-azo uracil, cytosine and thymine, 5-uracil (pseudo-uracil), 4-thiouracil, 8-halo, amino, thiol, thioalkyl, hydroxyl and other 8-substituted adenines and guanines, 5-trifluoromethyl and other 5-substituted uracils and cytosines, 7-methylguanine, deazapurines, heterocyclic substituted analogs of purines and pyrimidines, e.g., aminoethyoxy phenoxazine, derivatives of purines and pyrimidines (e.g., 1-alkyl-, 1-alkenyl-, heteroaromatic- and 1-alkynyl derivatives) and tautomers thereof, 8-oxo-N6-methyladenine, 7-diazaxanthine, 5-methylcytosine, 5-methyluracil, 5-(1-propynyl)uracil, 5-(1-propynyl) cytosine and 4,4-ethanocytosine). Other examples of suitable bases include non-purinyl and non-pyrimidinyl bases such as 2-aminopyridine and triazines.

Sugar Moieties

Sugar moieties in a nucleic acid disclosed herein may include 2'-hydroxyl-pentofuranosyl sugar moiety without any modification. Alternatively, sugar moieties can be modified such as, 2'-deoxy-pentofuranosyl sugar moiety, D-ribose, hexose, modification at the 2' position of the pentofuranosyl sugar moiety such as 2'-O-alkyl (including 2'OMe and 2'-O-ethyl), i.e., 2'-alkoxy, 2'-amino, 2'-O-allyl, 2'-S-alkyl, 2'-halogen (including 2'-fluoro, chloro, and bromo), 2'-methoxyethoxy, 2'-O-methoxyethyl, 2'-O-2-methoxyethyl, 2'-allyloxy (—OCH$_2$CH=CH$_2$), 2'-propargyl, 2'-propyl, ethynyl, ethenyl, propenyl, CF, cyano, imidazole, carboxylate, thioate, $C_1$ to $C_{10}$ lower alkyl, substituted lower alkyl, alkaryl or aralkyl, OCF$_3$, OCN, O-, S-, or N-alkyl; O-, S, or N-alkenyl; SOCH$_3$; SO$_2$CH$_3$; ONO$_2$; NO$_2$, N$_3$; heterocycloalkyl; heterocycloalkaryl; aminoalkylamino; polyalkylamino or substituted silyl, as, among others, for example as described in European patents EP0586520 or EP0618925.

Alkyl group includes saturated aliphatic groups, including straight-chain alkyl groups (e.g., methyl, ethyl, propyl, butyl, pentyl, hexyl, heptyl, octyl, nonyl, decyl, etc.), branched-chain alkyl groups (isopropyl, tert-butyl, isobutyl, etc.), cycloalkyl (alicyclic) groups (cyclopropyl, cyclopentyl, cyclohexyl, cycloheptyl, cyclooctyl), alkyl substituted cycloalkyl groups, and cycloalkyl substituted alkyl groups. In certain embodiments, a straight chain or branched chain alkyl has six or fewer carbon atoms in its backbone (e.g., $C_1$-$C_6$ for straight chain, $C_3$-$C_6$ for branched chain), and more preferably four or fewer. Likewise, preferred cycloalkyls may have from three to eight carbon atoms in their ring structure, and more preferably have five or six carbons in the ring structure. The term $C_1$-$C_6$ includes alkyl groups containing one to six carbon atoms. The alkyl group can be substituted alkyl group such as alkyl moieties having substituents replacing a hydrogen on one or more carbons of the hydrocarbon backbone. Such substituents can include, for example, alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

Alkoxy group includes substituted and unsubstituted alkyl, alkenyl, and alkynyl groups covalently linked to an oxygen atom. Examples of alkoxy groups include methoxy, ethoxy, isopropyloxy, propoxy, butoxy, and pentoxy groups. Examples of substituted alkoxy groups include halogenated alkoxy groups. The alkoxy groups can be substituted with groups such as alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moieties. Examples of halogen substituted alkoxy groups include, but are not limited to, fluoromethoxy, difluoromethoxy, trifluoromethoxy, chloromethoxy, dichloromethoxy, trichloromethoxy, etc.

In some embodiments, the pentafuranosyl ring may be replaced with acyclic derivatives lacking the $C_2$'-$C_3$'-bond of the pentafuronosyl ring. For example, acyclonucleotides may substitute a 2-hydroxyethoxymethyl group for-the 2'-deoxyribofuranosyl sugar normally present in dNMPs.

Halogens include fluorine, bromine, chlorine, iodine.

Backbone

The nucleoside subunits of the nucleic acid disclosed herein may be linked to each other by a phosphodiester bond. The phosphodiester bond may be optionally substituted with other linkages. For example, phosphorothioate, thiophosphate-D-ribose entities, triester, thioate, 2'-5' bridged backbone (may also be referred to as 5'-2' or 2'-5'-nucleotide or 2'-5'-ribonucleotide), PACE, 3'(or -5')-deoxy-3'(or -5')-thio-phosphorothioate, phosphorodithioate, phosphoroselenates, 3'(or -5')-deoxy phosphinates, borano phosphates, 3'(or -5')-deoxy-3'(or 5'-)-amino phosphoramidates, hydrogen phosphonates, phosphonates, borano phosphate esters, phosphoramidates, alkyl or aryl phosphonates and phosphotriester modifications such as alkylphosphotriesters, phosphotriester phosphorus linkages, 5'-ethoxyphosphodiester, P-alkyloxyphosphotriester, methylphosphonate, and nonphosphorus containing linkages for example, carbonate, carbamate, silyl, sulfur, sulfonate, sulfonamide, formacetal, thioformacetyl, oxime, methyleneimino, methylenemethylimino, methylenehydrazo, methylenedimethylhydrazo and methyleneoxymethylimino linkages.

Nucleic acid molecules disclosed herein may include a peptide nucleic acid (PNA) backbone. The PNA backbone includes repeating N-(2-aminoethyl)-glycine units linked by peptide bonds. The various bases such as purine, pyrimidine, natural and synthetic bases are linked to the backbone by methylene carbonyl bonds.

Terminal Phosphates

Modifications can be made at terminal phosphate groups. Non-limiting examples of different stabilization chemistries can be used, e.g., to stabilize the 3'-end of nucleic acid sequences, including (3'-3')-inverted deoxyribose; deoxyribonucleotide; (5'-3')-3'-deoxyribonucleotide; (5'-3')-ribonucleotide; (5'-3')-3'-O-methyl ribonucleotide; 3'-glyceryl; (3'-5')-3'-deoxyribonucleotide; (3'-3')-deoxyribonucleotide; (5'-2')-deoxyribonucleotide; and (5-3')-dideoxyribonucleotide. In addition, unmodified backbone chemistries can be combined with one or more different backbone modifications described herein.

Exemplary chemically modified terminal phosphate groups include those shown below:

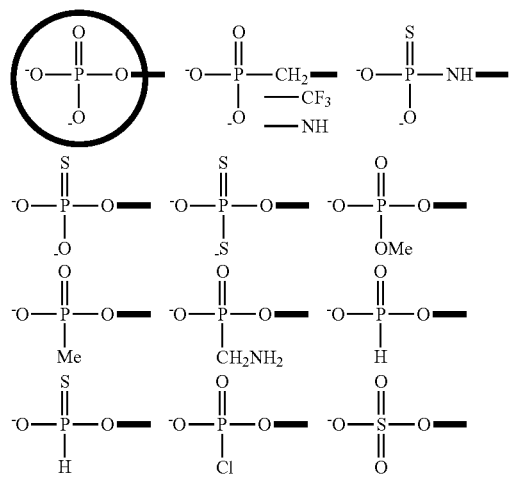

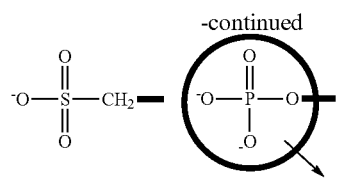

Sulfonic acid equivalent or Vanadyl equivalent with any combination of other modifications herein Conjugates Modified nucleotides and nucleic acid molecules (e.g., siNA molecules) as provided herein may include conjugates, for example, a conjugate covalently attached to the chemically-modified nucleic acid molecule. Non-limiting examples of conjugates include conjugates and ligands described in Vargeese et al., U.S. Ser. No. 10/427,160. The conjugate may be covalently attached to a nucleic acid molecule (such as an siNA molecule) via a biodegradable linker. The conjugate molecule may be attached at the 3'-end of either the sense strand, the antisense strand, or both strands of the chemically-modified nucleic acid molecule. The conjugate molecule may be attached at the 5'-end of either the sense strand, the antisense strand, or both strands of the chemically-modified nucleic acid molecule. The conjugate molecule may be attached both the 3'-end and 5'-end of either the sense strand, the antisense strand, or both strands of the chemically-modified nucleic acid molecule, or any combination thereof. In one embodiment, a conjugate molecule may include a molecule that facilitates delivery of a chemically-modified nucleic acid molecule into a biological system, such as a cell. In another embodiment, the conjugate molecule attached to the chemically-modified nucleic acid molecule is a polyethylene glycol, human serum albumin, or a ligand for a cellular receptor that can mediate cellular uptake. Examples of specific conjugate molecules contemplated by the instant description that can be attached to chemically-modified nucleic acid molecules are described in Vargeese et al., U.S. Ser. No. 10/201,394.

Linkers

A nucleic acid molecule provided herein (e.g., an siNA) may include a nucleotide, non-nucleotide, or mixed nucleotide/non-nucleotide linker that joins the sense region of the nucleic acid to the antisense region of the nucleic acid. A nucleotide linker can be a linker of ≥2 nt in length, for example about 3, 4, 5, 6, 7, 8, 9, or 10 nt in length. The nucleotide linker can be a nucleic acid aptamer. By "aptamer" or "nucleic acid aptamer" as used herein refers to a nucleic acid molecule that binds specifically to a target molecule wherein the nucleic acid molecule has sequence that includes a sequence recognized by the target molecule in its natural setting. Alternately, an aptamer can be a nucleic acid molecule that binds to a target molecule (such as hsp47 mRNA) where the target molecule does not naturally bind to a nucleic acid. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. See e.g., Gold et al.; 1995, Annu. Rev. Biochem., 64, 763; Brody and Gold, 2000, J. Biotechnol., 74, 5; Sun, 2000, Curr. Opin. Mol. Ther., 2, 100; Kusser, 2000, J. Biotechnol., 74, 27; Hermann and Patel, 2000, Science, 287, 820; and Jayasena, 1999, Clinical Chemistry, 45, 1628.

A non-nucleotide linker may include an abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, Nucleic Acids Res. 1990, 18:6353 and Nucleic Acids Res. 1987, 15:3113; Cload and Schepartz, J. Am. Chem. Soc. 1991, 113:6324; Richardson and Schepartz, J. Am. Chem. Soc. 1991, 113:5109; Ma et al., Nucleic Acids Res. 1993, 21:2585 and Biochemistry 1993, 32:1751; Durand et al., Nucleic Acids Res. 1990, 18:6353; McCurdy et al., Nucleosides & Nucleotides 1991, 10:287; Jschke et al., Tetrahedron Lett. 1993, 34:301; Ono et al., Biochemistry 1991, 30:9914; Arnold et al., WO8902439; Usman et al., WO9506731; Dudycz et al., WO9511910 and Ferentz and Verdine, J. Am. Chem. Soc. 1991, 113:4000.

5'-Ends, 3'-Ends, and Overhangs

Nucleic acid molecules disclosed herein (e.g., siNA molecules) may be blunt-ended on both sides, have overhangs on both sides, or a combination of blunt and overhang ends. Overhangs may occur on either the 5'- or 3'-end of the sense or antisense strand.

5'- and/or 3'-ends of double-stranded nucleic acid molecules (e.g., siNA) may be blunt ended or have an overhang. The 5'-end may be blunt ended and the 3'-end has an overhang in either the sense strand or the antisense strand. In other embodiments, the 3'-end may be blunt ended and the 5'-end has an overhang in either the sense strand or the antisense strand. In yet other embodiments, both the 5'- and 3'-end are blunt ended or both the 5'- and 3'-ends have overhangs.

The 5'- and/or 3'-end of one or both strands of the nucleic acid may include a free hydroxyl group. The 5'- and/or 3'-end of any nucleic acid molecule strand may be modified to include a chemical modification. Such modification may stabilize nucleic acid molecules, e.g., the 3'-end may have increased stability due to the presence of the nucleic acid molecule modification. Examples of end modifications (e.g., terminal caps) include, but are not limited to, abasic, deoxy abasic, inverted (deoxy) abasic, glyceryl, dinucleotide, acyclic nucleotide, amino, fluoro, chloro, bromo, CN, CF, methoxy, imidazole, carboxylate, thioate, $C_1$ to $C_{10}$ lower alkyl, substituted lower alkyl, alkaryl or aralkyl, $OCF_3$, OCN, O-, S-, or N-alkyl; O-, S-, or N-alkenyl; $SOCH_3$; $SO_2CH_3$; $ONO_2$; $NO_2$, $N_3$; heterocycloalkyl; heterocycloalkaryl; aminoalkylamino; polyalkylamino or substituted silyl, as, among others, described in European patents EP586520 and EP618925 and other modifications disclosed herein.

Nucleic acid molecules include those with blunt ends, i.e., ends that do not include any overhanging nucleotides. A nucleic acid molecule can include one or more blunt ends. The blunt ended nucleic acid molecule has a number of base pairs equal to the number of nucleotides present in each strand of the nucleic acid molecule. The nucleic acid molecule can include one blunt end, for example where the 5'-end of the antisense strand and the 3'-end of the sense strand do not have any overhanging nucleotides. Nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. Other nucleotides present in a blunt ended nucleic acid molecule can include, for example, mismatches, bulges, loops, or wobble base pairs to modulate the activity of the nucleic acid molecule to mediate RNA interference.

In certain embodiments of the nucleic acid molecules (e.g., siNA molecules) provided herein, at least one end of the molecule has an overhang of at least one nucleotide (for example one to eight overhang nucleotides). For example, one or both strands of a double-stranded nucleic acid molecule disclosed herein may have an overhang at the 5'-end or at the 3'-end or both. An overhang may be present at either or both the sense strand and antisense strand of the nucleic acid molecule. The length of the overhang may be as little as one nucleotide and as long as one to eight or more nt (e.g., 1, 2, 3, 4, 5, 6, 7 or 8 nt; in some preferred embodiments an overhang is 2, 3, 4, 5, 6, 7 or 8 nt; for example an overhang may be 2 nt. The nucleotide(s) forming the overhang may include deoxyribonucleotide(s), ribonucleotide(s), natural and non-natural nucleobases or any nucleotide modified in the sugar, base or phosphate group such as disclosed herein. A double-stranded nucleic acid molecule may have both 5'- and 3'-overhangs. The overhangs at the 5'- and 3'-end may be of different lengths. An overhang may include at least one nucleic acid modification which may be deoxyribonucleotide. One or more deoxyribonucleotides may be at the 5'-terminal. The 3'-end of the respective counter-strand of the nucleic acid molecule may not have an overhang, more preferably not a deoxyribonucleotide overhang. The one or more deoxyribonucleotide may be at the 3'-terminal. The 5'-end of the respective counter-strand of the dsRNA may not have an overhang, more preferably not a deoxyribonucleotide overhang. The overhang in either the 5'- or the 3'-end of a strand may be one to eight (e.g., about 1, 2, 3, 4, 5, 6, 7 or 8) unpaired nucleotides, preferably, the overhang is two to three unpaired nucleotides; more preferably two unpaired nucleotides. Nucleic acid molecules may include duplex nucleic acid molecules with overhanging ends of about 1 to about 20 (e.g., about 1, 2, 3, 4, 5, 6, 7, 8, 9, 10, 11, 12, 13, 1, 15, 16, 17, 18, 19 or 20); preferably one to eight (e.g., about 1, 2, 3, 4, 5, 6, 7 or 8) nt, for example, about 21-nucleotide duplexes with about 19 base pairs and 3'-terminal mononucleotide, dinucleotide, or trinucleotide overhangs. Nucleic acid molecules herein may include duplex nucleic acid molecules with blunt ends, where both ends are blunt, or alternatively, where one of the ends is blunt. Nucleic acid molecules disclosed herein can include one or more blunt ends, i.e., where a blunt end does not have any overhanging nucleotides. In one embodiment, the blunt ended nucleic acid molecule has a number of base pairs equal to the number of nucleotides present in each strand of the nucleic acid molecule. The nucleic acid molecule may include one blunt end, for example where the 5'-end of the antisense strand and the 3'-end of the sense strand do not have any overhanging nucleotides. The nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. In certain preferred embodiments the nucleic acid compounds are blunt ended. Other nucleotides present in a blunt ended siNA molecule can include, for example, mismatches, bulges, loops, or wobble base pairs to modulate the activity of the nucleic acid molecule to mediate RNA interference.

In many embodiments one or more, or all, of the overhang nucleotides of a nucleic acid molecule (e.g., a siNA molecule) as described herein includes are modified such as described herein; for example one or more, or all, of the nucleotides may be 2'-deoxynucleotides.

Amount, Location and Patterns of Modifications

Nucleic acid molecules (e.g., siNA molecules) disclosed herein may include modified nucleotides as a percentage of the total number of nucleotides present in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given nucleic acid molecule will depend on the total number of nucleotides present in the nucleic acid. If the nucleic acid molecule is single-stranded, the percent modification can be based upon the total number of nucleotides present in the single-stranded nucleic acid molecule. Likewise, if the nucleic acid molecule is double-stranded, the percent modification can be based upon the total number of nucleotides present in the sense strand, antisense strand, or both the sense and antisense strands.

Nucleic acid molecules disclosed herein may include unmodified RNA as a percentage of the total nucleotides in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100%) of total nucleotides present in a nucleic acid molecule.

A nucleic acid molecule (e.g., an siNA molecule) may include a sense strand that includes about one to about five, specifically about 1, 2, 3, 4, or 5 phosphorothioate internucleotide linkages, and/or one or more (e.g., about 1, 2, 3, 4, 5, or more) 2'-deoxy, 2'OMe, 2'-deoxy-2'-fluoro, and/or one or more (e.g., about 1, 2, 3, 4, 5, or more) universal base modified nucleotides, and optionally a terminal cap molecule at the 3'-end, the 5'-end, or both of the 3'- and 5'-ends of the sense strand; and wherein the antisense strand includes about one to about five or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'OMe, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. A nucleic acid molecule may include about 1, 2, 3, 4, 5, 6, 7, 8, 9, 10, or more, pyrimidine nucleotides of the sense and/or antisense nucleic acid strand are chemically-modified with 2'-deoxy, 2'OMe and/or 2'-deoxy-2'-fluoro nucleotides, with or without about one to about five or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

A nucleic acid molecule may include about one to about five or more (specifically about 1, 2, 3, 4, 5, or more) phosphorothioate internucleotide linkages in each strand of the nucleic acid molecule.

A nucleic acid molecule may include 2'-5' internucleotide linkages, for example at the 3'-end, the 5'-end, or both of the 3'- and 5'-ends of one or both nucleic acid sequence strands. In addition, the 2'-5' internucleotide linkage(s) can be present at various other positions within one or both nucleic acid sequence strands, for example about 1, 2, 3, 4, 5, 6, 7, 8, 9, 10, or more including every internucleotide linkage of a pyrimidine nucleotide in one or both strands of the siNA molecule can include a 2'-5' internucleotide linkage, or about 1, 2, 3, 4, 5, 6, 7, 8, 9, 10, or more including every internucleotide linkage of a purine nucleotide in one or both strands of the siNA molecule can include a 2'-5' internucleotide linkage.

A chemically-modified short interfering nucleic acid (siNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

A chemically-modified short interfering nucleic acid (siNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'OMe purine nucleotides (e.g., wherein all purine nucleotides are 2'OMe purine nucleotides or alternately a plurality of purine nucleotides are 2'OMe purine nucleotides).

A chemically-modified siNA molecule capable of mediating RNA interference (RNAi) against hsp47 inside a cell or reconstituted in vitro system may include a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the antisense region are 2'OMe purine nucleotides (e.g., wherein all purine nucleotides are 2'OMe purine nucleotides or alternately a plurality of purine nucleotides are 2'OMe purine nucleotides). The sense region and/or the antisense region can have a terminal cap modification, such as any modification that is optionally present at the 3'-end, the 5'-end, or both of the 3' and 5'-ends of the sense and/or antisense sequence. The sense and/or antisense region can optionally further include a 3'-terminal nucleotide overhang having about 1 to about 4 (e.g., about 1, 2, 3, or 4) 2'-deoxynucleotides. The overhang nucleotides can further include one or more (e.g., about 1, 2, 3, 4 or more) phosphorothioate, phosphonoacetate, and/or thiophosphonoacetate internucleotide linkages. The purine nucleotides in the sense region may alternatively be 2'OMe purine nucleotides (e.g., wherein all purine nucleotides are 2'OMe purine nucleotides or alternately a plurality of purine nucleotides are 2'OMe purine nucleotides) and one or more purine nucleotides present in the antisense region are 2'OMe purine nucleotides (e.g., wherein all purine nucleotides are 2'OMe purine nucleotides or alternately a plurality of purine nucleotides are 2'OMe purine nucleotides). One or more purine nucleotides in the sense region may alternatively be purine ribonucleotides (e.g., wherein all purine nucleotides are purine ribonucleotides or alternately a plurality of purine nucleotides are purine ribonucleotides) and any purine nucleotides present in the antisense region are 2'OMe purine nucleotides (e.g., wherein all purine nucleotides are 2'OMe purine nucleotides or alternately a plurality of purine nucleotides are 2'OMe purine nucleotides). One or more purine nucleotides in the sense region and/or present in the antisense region may alternatively selected from the group consisting of 2'-deoxy nucleotides, LNA nucleotides, 2'-methoxyethyl nucleotides, 4'-thionucleotides, and 2'OMe nucleotides (e.g., wherein all purine nucleotides are selected from the group consisting of 2'-deoxy nucleotides, LNA nucleotides, 2'-methoxyethyl nucleotides, 4'-thionucleotides, and 2'OMe nucleotides or alternately a plurality of purine nucleotides are selected from the group consisting of 2'-deoxy nucleotides, LNA nucleotides, 2'-methoxyethyl nucleotides, 4'-thionucleotides, and 2'OMe nucleotides).

In some embodiments, a nucleic acid molecule (e.g., a siNA molecule) as described herein includes a modified nucleotide (for example one modified nucleotide) in the antisense strand; for example in position 6 or position 7 of the antisense strand.

Modification Patterns and Alternating Modifications

Nucleic acid molecules (e.g., siNA molecules) provided herein may have patterns of modified and unmodified nucleic acids. A pattern of modification of the nucleotides in a contiguous stretch of nucleotides may be a modification contained within a single nucleotide or group of nucleotides that are covalently linked to each other via standard phosphodiester bonds or, at least partially, through phosphorothioate bonds. Accordingly, a "pattern" as contemplated herein, does not necessarily need to involve repeating units, although it may. Examples of modification patterns that may be used in conjunction with the nucleic acid molecules (e.g., siNA molecules) provided herein include those disclosed in Giese, U.S. Pat. No. 7,452,987. For example, nucleic acid molecules (e.g., siNA molecules) provided herein include those with modification patterns such as, similar to, or the same as, the patterns shown diagrammatically in FIG. 2 of U.S. Pat. No. 7,452,987.

A modified nucleotide or group of modified nucleotides may be at the 5'-end or 3'-end of the sense or antisense strand, a flanking nucleotide or group of nucleotides is arrayed on both sides of the modified nucleotide or group, where the flanking nucleotide or group either is unmodified or does not have the same modification of the preceding nucleotide or group of nucleotides. The flanking nucleotide or group of nucleotides may, however, have a different modification. This sequence of modified nucleotide or group of modified nucleotides, respectively, and unmodified or differently modified nucleotide or group of unmodified or differently modified nucleotides may be repeated one or more times.

In some patterns, the 5'-terminal nucleotide of a strand is a modified nucleotide while in other patterns the 5'-terminal nucleotide of a strand is an unmodified nucleotide. In some patterns, the 5'-end of a strand starts with a group of modified nucleotides while in other patterns, the 5'-terminal end is an unmodified group of nucleotides. This pattern may be either on the first stretch or the second stretch of the nucleic acid molecule or on both.

Modified nucleotides of one strand of the nucleic acid molecule may be complementary in position to the modified or unmodified nucleotides or groups of nucleotides of the other strand.

There may be a phase shift between modifications or patterns of modifications on one strand relative to the pattern of modification of the other strand such that the modification groups do not overlap. In one instance, the shift is such that the modified group of nucleotides of the sense strand corresponds to the unmodified group of nucleotides of the antisense strand and vice versa.

There may be a partial shift of the pattern of modification such that the modified groups overlap. The groups of modified nucleotides in any given strand may optionally be the same length, but may be of different lengths. Similarly, groups of unmodified nucleotides in any given strand may optionally be the same length, or of different lengths.

In some patterns, the second (penultimate) nucleotide at the terminus of the strand, is an unmodified nucleotide or the beginning of group of unmodified nucleotides. Preferably, this unmodified nucleotide or unmodified group of nucleotides is located at the 5'-end of the either or both the sense and antisense strands and even more preferably at the terminus of the sense strand. An unmodified nucleotide or unmodified group of nucleotide may be located at the 5'-end of the sense strand. In a preferred embodiment the pattern consists of alternating single modified and unmodified nucleotides.

Some double-stranded nucleic acid molecules include a 2'OMe modified nucleotide and a non-modified nucleotide, preferably a nucleotide which is not 2'OMe modified, are incorporated on both strands in an alternating fashion, resulting in a pattern of alternating 2'OMe modified nucleotides and nucleotides that are either unmodified or at least do not include a 2'OMe modification. In certain embodiments, the same sequence of 2'OMe modification and non-modification exists on the second strand; in other embodiments the alternating 2'OMe modified nucleotides are only present in the sense strand and are not present in the antisense strand; and in yet other embodiments the alternating 2'OMe modified nucleotides are only present in the sense strand and are not present in the antisense strand. In certain embodiments, there is a phase shift between the two strands such that the 2'OMe modified nucleotide on the first strand base pairs with a non-modified nucleotide(s) on the second strand and vice versa. This particular arrangement, i.e., base pairing of 2'OMe modified and non-modified nucleotide(s) on both strands is particularly preferred in certain embodiments. In certain embodiments, the pattern of alternating 2'OMe modified nucleotides exists throughout the entire nucleic acid molecule; or the entire duplex region. In other embodiments the pattern of alternating 2'OMe modified nucleotides exists only in a portion of the nucleic acid; or the entire duplex region.

In "phase shift" patterns, it may be preferred if the antisense strand starts with a 2'OMe modified nucleotide at the 5'-end whereby consequently the second nucleotide is non-modified, the third, fifth, seventh and so on nucleotides are thus again 2'OMe modified whereas the second, fourth, sixth, eighth and the like nucleotides are non-modified nucleotides.

Modification Locations and Patterns

While exemplary patterns are provided in more detail below, all permutations of patterns with of all possible characteristics of the nucleic acid molecules disclosed herein and those known in the art are contemplated (e.g., characteristics include, but are not limited to, length of sense strand, length of antisense strand, length of duplex region, length of overhang, whether one or both ends of a double-stranded nucleic acid molecule is blunt or has an overhang, location of modified nucleic acid, number of modified nucleic acids, types of modifications, whether a double overhang nucleic acid molecule has the same or different number of nucleotides on the overhang of each side, whether a one or more than one type of modification is used in a nucleic acid molecule, and number of contiguous modified/unmodified nucleotides). With respect to all detailed examples provided below, while the duplex region is shown to be 19 nucleotides, the nucleic acid molecules provided herein can have a duplex region ranging from 1 to 49 nucleotides in length as each strand of a duplex region can independently be 17-49 nt in length Exemplary patterns are provided herein.

Nucleic acid molecules may have a blunt end (when n is 0) on both ends that include a single or contiguous set of modified nucleic acids. The modified nucleic acid may be located at any position along either the sense or antisense strand. Nucleic acid molecules may include a group of about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 contiguous modified nucleotides. Modified nucleic acids may make up 1%, 2%, 3%, 5%, 10%, 15%, 20%, 25%, 30%, 35%, 40%, 45%, 50%, 55%, 60%, 65%, 70%, 75%, 80%, 85%, 90%, 95%, 97%, 98% or 100% of a nucleic acid strand. Modified nucleic acids of the examples immediately below may be in the sense strand only, the antisense strand only, or in both the sense and antisense strand.

General nucleic acid patterns are shown below where X=sense strand nucleotide in the duplex region; $X_a$=5'-overhang nucleotide in the sense strand; $X_b$=3'-overhang nucleotide in the sense strand; Y=antisense strand nucleotide in the duplex region; $Y_a$=3'-overhang nucleotide in the antisense strand; $Y_b$=5'-overhang nucleotide in the antisense strand; and M=a modified nucleotide in the duplex region. Each a and b are independently 0 to 8 (e.g., 0, 1, 2, 3, 4, 5, 6, 7 or 8). Each X, Y, a and b are independently modified or unmodified. The sense and antisense strands can are each independently 17-49 nucleotides in length. The examples provided below have a duplex region of 19 nucleotides; however, nucleic acid molecules disclosed herein can have a duplex region anywhere between 17 and 49 nucleotides and where each strand is independently between 17 and 49 nucleotides in length.

```
5'    XaXXXXXXXXXXXXXXXXXXXXb
3'    YbYYYYYYYYYYYYYYYYYYYa
```

Further exemplary nucleic acid molecule patterns are shown below where X=unmodified sense strand nucleotides; x=an unmodified overhang nucleotide in the sense strand; Y=unmodified antisense strand nucleotides; y=an unmodified overhang nucleotide in the antisense strand; and M=a modified nucleotide. The sense and antisense strands can are each independently 17-49 nt in length. The examples provided below have a duplex region of 19 nt; however, nucleic acid molecules disclosed herein can have a duplex region anywhere between 17 and 49 nt and where each strand is independently between 17 and 49 n in length.

```
5'    MnXXXXXXXXXMXXXXXXXXXMn
3'    MnYYYYYYYYYYYYYYYYYYYMn
```

```
5'    XXXXXXXXXXXXXXXXXXX
3'    YYYYYYYYMYYYYYYYYYY

5'    XXXXXXXXXMMXXXXXXXXX
3'    YYYYYYYYYYYYYYYYYYYY

5'    XXXXXXXXXXXXXXXXXXX
3'    YYYYYYYYMMYYYYYYYYY

5'    XXXXXXXXXMXXXXXXXXX
3'    YYYYYYYYYMYYYYYYYYY

5'    XXXXXMXXXXXXXXXXXXX
3'    YYYYYYYYYMYYYYYYYYY

5'    MXXXXXXXXXXXXXXXXXX
3'    YYYYYYYYYYYYYMYYYYY

5'    XXXXXXXXXXXXXXXXXXM
3'    YYYYMYYYYYYYYYYYYYY

5'    XXXXXXXXXMXXXXXXXXX
3'    MYYYYYYYYYYYYYYYYYY

5'    XXXXXXXMXXXXXXXXXXX
3'    YYYYYYYYYYYYYYYYYYM

5'    XXXXXXXXXXXXXMXXXX
3'    MYYYYYYYYYYYYYYYYYY

5'    MMMMMMMMMMMMMMMM
3'    MMMMMMMMMMMMMMMM
```

Nucleic acid molecules may have blunt ends on both ends with alternating modified nucleic acids. The modified nucleic acids may be located at any position along either the sense or antisense strand.

```
5'    MXMXMXMXMXMXMXMXMXM
3'    YMYMYMYMYMYMYMYMYMY

5'    XMXMXMXMXMXMXMXMXMX
3'    MYMYMYMYMYMYMYMYMYM

5'    MMXMMXMMXMMXMMXMMXM
3'    YMMYMMYMMYMMYMMYMMY

5'    XMMXMMXMMXMMXMMXMMX
3'    MMYMMYMMYMMYMMYMMYM

5'    MMMXMMMXMMMXMMMXMMM
3'    YMMMYMMMYMMMYMMMYMM

5'    XMMMXMMMXMMMXMMMXMM
3'    MMMYMMMYMMMYMMMYMMM
```

Nucleic acid molecules with a blunt 5'-end and 3'-end overhang end with a single modified nucleic acid.

Nucleic acid molecules with a 5'-end overhang and a blunt 3'-end with a single modified nucleic acid.

Nucleic acid molecules with overhangs on both ends and all overhangs are modified nucleic acids. In the pattern immediately below, M is n number of modified nucleic acids, where n is an integer from 0 to 8 (i.e., 0, 1, 2, 3, 4, 5, 6, 7 and 8).

```
5'    XXXXXXXXXXXXXXXXXXXM
3'    MYYYYYYYYYYYYYYYYYYY
```

Nucleic acid molecules with overhangs on both ends and some overhang nucleotides are modified nucleotides. In the patterns immediately below, M is n number of modified nucleotides, x is n number of unmodified overhang nucleotides in the sense strand, y is n number of unmodified overhang nucleotides in the antisense strand, where each n is independently an integer from 0 to 8 (i.e., 0, 1, 2, 3, 4, 5, 6, 7 and 8), and where each overhang is maximum of 20 nt; preferably a maximum of 8 nt (modified and/or unmodified).

```
5'          XXXXXXXXXXXXXXXXXXXXM
3'          yYYYYYYYYYYYYYYYYYYYY

5'          XXXXXXXXXXXXXXXXXXXXMx
3'          yYYYYYYYYYYYYYYYYYYYY

5'          XXXXXXXXXXXXXXXXXXXXMxM
3'          yYYYYYYYYYYYYYYYYYYYY

5'          XXXXXXXXXXXXXXXXXXXXMxMx
3'          yYYYYYYYYYYYYYYYYYYYY

5'          XXXXXXXXXXXXXXXXXXXXMxMxM
3'          yYYYYYYYYYYYYYYYYYYYY

5'          XXXXXXXXXXXXXXXXXXXXMxMxMx
3'          yYYYYYYYYYYYYYYYYYYYY

5'          XXXXXXXXXXXXXXXXXXXXMxMxMxM
3'          yYYYYYYYYYYYYYYYYYYYY

5'          XXXXXXXXXXXXXXXXXXXXMxMxMxMx
3'          yYYYYYYYYYYYYYYYYYYYY

5'          MXXXXXXXXXXXXXXXXXXXX
3'          YYYYYYYYYYYYYYYYYYYYy

5'          xMXXXXXXXXXXXXXXXXXXXX
3'          YYYYYYYYYYYYYYYYYYYYy

5'          MxMXXXXXXXXXXXXXXXXXXXX
3'          YYYYYYYYYYYYYYYYYYYYy

5'          xMxMXXXXXXXXXXXXXXXXXXXX
3'          YYYYYYYYYYYYYYYYYYYYy

5'          MxMxMXXXXXXXXXXXXXXXXXXXX
3'          YYYYYYYYYYYYYYYYYYYYy

5'          xMxMxMXXXXXXXXXXXXXXXXXXXX
3'          YYYYYYYYYYYYYYYYYYYYy

5'          MxMxMxMXXXXXXXXXXXXXXXXXXXX
3'          YYYYYYYYYYYYYYYYYYYYy

5'          xMxMxMxMXXXXXXXXXXXXXXXXXXXX
3'          YYYYYYYYYYYYYYYYYYYYy

5'          xXXXXXXXXXXXXXXXXXXXX
3'          YYYYYYYYYYYYYYYYYYYYM

5'          xXXXXXXXXXXXXXXXXXXXX
3'          YYYYYYYYYYYYYYYYYYYYMy

5'          xXXXXXXXXXXXXXXXXXXXX
3'          YYYYYYYYYYYYYYYYYYYYMyM

5'          xXXXXXXXXXXXXXXXXXXXX
3'          YYYYYYYYYYYYYYYYYYYYMyMy

5'          xXXXXXXXXXXXXXXXXXXXX
3'          YYYYYYYYYYYYYYYYYYYYMyMyM

5'          xXXXXXXXXXXXXXXXXXXXX
3'          YYYYYYYYYYYYYYYYYYYYMyMyMy

5'          xXXXXXXXXXXXXXXXXXXXX
3'          YYYYYYYYYYYYYYYYYYYYMyMyMyM

5'          xXXXXXXXXXXXXXXXXXXXX
3'          YYYYYYYYYYYYYYYYYYYYMyMyMyMy

5'          XXXXXXXXXXXXXXXXXXXXx
3'          MYYYYYYYYYYYYYYYYYYYY

5'          XXXXXXXXXXXXXXXXXXXXx
3'          yMYYYYYYYYYYYYYYYYYYYY

5'          XXXXXXXXXXXXXXXXXXXXx
3'          MyMYYYYYYYYYYYYYYYYYYYY

5'          XXXXXXXXXXXXXXXXXXXXx
3'          yMyMYYYYYYYYYYYYYYYYYYYY

5'          XXXXXXXXXXXXXXXXXXXXx
3'          MyMyMYYYYYYYYYYYYYYYYYYYY

5'          XXXXXXXXXXXXXXXXXXXXx
3'          yMyMyMYYYYYYYYYYYYYYYYYYYY

5'          XXXXXXXXXXXXXXXXXXXXx
3'          MyMyMyMYYYYYYYYYYYYYYYYYYYY

5'          XXXXXXXXXXXXXXXXXXXXx
3'          yMyMyMyMYYYYYYYYYYYYYYYYYYYY
```

Modified nucleotides at the 3'-end of the sense region.

```
5'          XXXXXXXXXXXXXXXXXXXXM
3'          YYYYYYYYYYYYYYYYYYYY

5'          XXXXXXXXXXXXXXXXXXXXMM
3'          YYYYYYYYYYYYYYYYYYYY

5'          XXXXXXXXXXXXXXXXXXXXMMM
3'          YYYYYYYYYYYYYYYYYYYY

5'          XXXXXXXXXXXXXXXXXXXXMMMM
3'          YYYYYYYYYYYYYYYYYYYY

5'          XXXXXXXXXXXXXXXXXXXXMMMMM
3'          YYYYYYYYYYYYYYYYYYYY

5'          XXXXXXXXXXXXXXXXXXXXMMMMMM
3'          YYYYYYYYYYYYYYYYYYYY

5'          XXXXXXXXXXXXXXXXXXXXMMMMMMM
3'          YYYYYYYYYYYYYYYYYYYY

5'          XXXXXXXXXXXXXXXXXXXXMMMMMMMM
3'          YYYYYYYYYYYYYYYYYYYY
```

Overhang at the 5'-end of the sense region.

```
5'          MXXXXXXXXXXXXXXXXXXXX
3'          YYYYYYYYYYYYYYYYYYYY

5'          MMXXXXXXXXXXXXXXXXXXXX
3'          YYYYYYYYYYYYYYYYYYYY

5'          MMMXXXXXXXXXXXXXXXXXXXX
3'          YYYYYYYYYYYYYYYYYYYY

5'          MMMMXXXXXXXXXXXXXXXXXXXX
3'          YYYYYYYYYYYYYYYYYYYY

5'          MMMMMXXXXXXXXXXXXXXXXXXXX
3'          YYYYYYYYYYYYYYYYYYYY

5'          MMMMMMXXXXXXXXXXXXXXXXXXXX
3'          YYYYYYYYYYYYYYYYYYYY

5'          MMMMMMMXXXXXXXXXXXXXXXXXXXX
3'          YYYYYYYYYYYYYYYYYYYY

5'          MMMMMMMMXXXXXXXXXXXXXXXXXXXX
3'          YYYYYYYYYYYYYYYYYYYY
```

Overhang at the 3'-end of the antisense region.

```
5'               XXXXXXXXXXXXXXXXXXX
3'              MYYYYYYYYYYYYYYYYYYY

5'               XXXXXXXXXXXXXXXXXXX
3'             MMYYYYYYYYYYYYYYYYYYY

5'               XXXXXXXXXXXXXXXXXXX
3'            MMMYYYYYYYYYYYYYYYYYYY

5'               XXXXXXXXXXXXXXXXXXX
3'           MMMMYYYYYYYYYYYYYYYYYYY

5'               XXXXXXXXXXXXXXXXXXX
3'          MMMMMYYYYYYYYYYYYYYYYYYY

5'               XXXXXXXXXXXXXXXXXXX
3'         MMMMMMYYYYYYYYYYYYYYYYYYY

5'               XXXXXXXXXXXXXXXXXXX
3'        MMMMMMMYYYYYYYYYYYYYYYYYYY

5'               XXXXXXXXXXXXXXXXXXX
3'       MMMMMMMMYYYYYYYYYYYYYYYYYYY
```

Modified nucleotide(s) within the sense region

```
5'            XXXXXXXXXMXXXXXXXXX
3'            YYYYYYYYYYYYYYYYYYY

5'            XXXXXXXXXXXXXXXXXXX
3'            YYYYYYYYYMYYYYYYYYY

5'            XXXXXXXXXXXXXXXXXXXMM
3'            YYYYYYYYYYYYYYYYYYY

5'            XXXXXXXXXXXXXXXXXXX
3'           MMYYYYYYYYYYYYYYYYYYY
```

Exemplary nucleic acid molecules are provided below along with the equivalent general structure in line with the symbols used above:

siHSP47-C siRNA to human and rat hsp47 having a 19 nucleotide (i.e., 19mer) duplex region and modified 2 nucleotide (i.e., deoxynucleotide) overhangs at the 3'-ends of the sense and antisense strands.

```
5'      GGACAGGCCUCUACAACUAdTdT    3' (SEQ ID NO: 5)
3' dTdTCCUGUCCGGAGAUGUUGAU         5' (SEQ ID NO: 6)

5'      XXXXXXXXXXXXXXXXXXXMM      3'
3'     MMYYYYYYYYYYYYYYYYYYY       5'
``` siHSP47-Cd siRNA to human and rat hsp47 having a 25-mer duplex region, a 2 nucleotide overhang at the 3'-end of the antisense strand and 2 modified nucleotides at the 5'-terminal and penultimate positions of the sense strand.

```
5'      GGACAGGCCUCUACAACUACUACdGdA  3' (SEQ ID NO: 9)
3' UUCCUGUCCGGAGAUGUUGAUGAUGCU       5' (SEQ ID
                                         NO: 10)

5'      XXXXXXXXXXXXXXXXXXXXXXXMM    3'
3'   yyYYYYYYYYYYYYYYYYYYYYYYYYY     5'
``` siHSP47-1 siRNA to human and rat hsp47 cDNA 719-737 having a 19-mer duplex region, and modified 2 nucleotide (i.e., deoxynucleotide) overhangs at the 3'-ends of the sense and antisense strands.

```
5'      CAGGCCUCUACAACUACUAdTdT    3' (SEQ ID NO: 13)
3' dTdTGUCCGGAGAUGUUGAUGAU         5' (SEQ ID NO: 14)

5'      XXXXXXXXXXXXXXXXXXXMM      3'
3'     MMYYYYYYYYYYYYYYYYYYY       5'
``` siHSP47-1d siRNA to human hsp47 cDNA 719-743 having a 25-mer with a blunt end at the 3'-end of the sense strand and a 2 nucleotide overhang at the 3'-end of the antisense strand, and 2 modified nucleotides at the 5'-terminal and penultimate positions of the sense strand.

```
5'      CAGGCCUCUACAACUACUACGACdGdA  3' (SEQ ID
                                         NO: 17)
3'  UUGUCCGGAGAUGUUGAUGAUGCUGCU      5' (SEQ ID
                                         NO: 2724)

5'      XXXXXXXXXXXXXXXXXXXXXXXMM    3'
3'   yyYYYYYYYYYYYYYYYYYYYYYYYYY     5'
``` siHSP47-2 siRNA to human hsp47 cDNA 469-487 having a 19-mer duplex region, and modified 2 nucleotide (i.e., deoxynucleotide) overhangs at the 3'-ends of the sense and antisense strands.

```
5'      GAGCACUCCAAGAUCAACUdTdT    3' (SEQ ID NO: 21)
3' dTdTCUCGUGAGGUUCUAGUUGA         5' (SEQ ID NO: 22)

5'      XXXXXXXXXXXXXXXXXXXMM      3'
3'     MMYYYYYYYYYYYYYYYYYYY       5'
``` siHSP47-2d siRNA to human hsp47 cDNA 469-493 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      GAGCACUCCAAGAUCAACUUCCGdCdG  3' (SEQ ID
                                         NO: 25)
3'  UUCUCGUGAGGUUCUAGUUGAAGGCGC      5' (SEQ ID
                                         NO: 24)

5'      XXXXXXXXXXXXXXXXXXXXXXXMM    3'
3'   yyYYYYYYYYYYYYYYYYYYYYYYYYY     5'
``` siHSP47-2d rat siRNA to rat Gp46 cDNA 466-490 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      GAACACUCCAAGAUCAACUUCCGdAdG  3' (SEQ ID
                                         NO: 29)
3'  UUCUUGUGAGGUUCUAGUUGAAGGCUC      5' (SEQ ID
                                         NO: 28)

5'      XXXXXXXXXXXXXXXXXXXXXXXMM    3'
3'   yyYYYYYYYYYYYYYYYYYYYYYYYYY     5'
``` siHSP47-3 siRNA to human hsp47 cDNA 980-998 having a 19-mer duplex region, and modified 2 nucleotide (i.e., deoxynucleotide) overhangs at the 3'-ends of the sense and antisense strands.

```
5'     CTGAGGCCATTGACAAGAAdTdT    3' (SEQ ID
                                     NO: 2725)
3' dTdTGACUCCGGUAACUGUUCUU        5' (SEQ ID NO: 34)

5'     XXXXXXXXXXXXXXXXXXXMM      3'
3' MMYYYYYYYYYYYYYYYYYYY          5'
``` siHSP47-3d siRNA to human hsp47 cDNA 980-1004 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'     CTGAGGCCATTGACAAGAACAAGdGdC   3' (SEQ ID NO: 2726)
3' UUGACUCCGGUAACUGUUCUUGUUCCG       5' (SEQ ID NO: 38)

5'     XXXXXXXXXXXXXXXXXXXXXXXMM     3'
3' yyYYYYYYYYYYYYYYYYYYYYYYYY        5'
``` siHSP47-4 siRNA to human hsp47 cDNA 735-753 having a 19-mer duplex region, and modified 2 nucleotide (i.e., deoxynucleotide) overhangs at the 3'-ends of the sense and antisense strands.

```
5'     CUACGACGACGAGAAGGAAdTdT     3' (SEQ ID NO: 41)
3' dTdTGAUGCUGCUGCUCUUCCUU         5' (SEQ ID NO: 42)

5'     XXXXXXXXXXXXXXXXXXXMM       3'
3' MMYYYYYYYYYYYYYYYYYYY           5'
``` siHSP47-4d siRNA to human hsp47 cDNA 735-759 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'     CUACGACGACGAGAAGGAAAAGCdTdG   3' (SEQ ID NO: 45)
3' UUGAUGCUGCUGCUCUUCCUUUUCGAC       5' (SEQ ID NO: 2727)

5'     XXXXXXXXXXXXXXXXXXXXXXXMM     3'
3' yyYYYYYYYYYYYYYYYYYYYYYYYY        5'
``` siHSP47-5 siRNA to human hsp47 cDNA 621-639 having a 19-mer duplex region, and modified 2 nucleotide (i.e., deoxynucleotide) overhangs at the 3'-ends of the sense and antisense strands.

```
5'     GCCACACUGGGAUGAGAAAdTdT     3' (SEQ ID NO: 49)
3' dTdTCGGUGUGACCCUACUCUUU         5' (SEQ ID NO: 50)

5'     XXXXXXXXXXXXXXXXXXXMM       3'
3' MMYYYYYYYYYYYYYYYYYYY           5'
``` siHSP47-6 siRNA to human hsp47 cDNA 446-464 having a 19-mer duplex region, and modified 2 nucleotide (i.e., deoxynucleotide) overhangs at the 3'-ends of the sense and antisense strands.

```
5'     GCAGCAAGCAGCACUACAAdTdT     3' (SEQ ID NO: 53)
3' dTdTCGUCGUUCGUCGUGAUGUU         5' (SEQ ID NO: 55)

5'     XXXXXXXXXXXXXXXXXXXMM       3'
3' MMYYYYYYYYYYYYYYYYYYY           5'
``` siHSP47-7 siRNA to human hsp47 cDNA 692-710 having a 19-mer duplex region, and modified 2 nucleotide (i.e., deoxynucleotide) overhangs at the 3'-ends of the sense and antisense strands.

```
5'     CCGUGGGUGUCAUGAUGAUdTdT     3' (SEQ ID NO: 57)
3' dTdTGGCACCCACAGUACUACUA         5' (SEQ ID NO: 58)

5'     XXXXXXXXXXXXXXXXXXXMM       3'
3' MMYYYYYYYYYYYYYYYYYYY           5'
```

Nicks and Gaps in Nucleic Acid Strands

Nucleic acid molecules (e.g., siNA molecules) provided herein may have a strand, preferably, the sense strand, that is nicked or gapped. As such, nucleic acid molecules may have three or more strand, for example, such as a meroduplex RNA (mdRNA). Nucleic acid molecules with a nicked or gapped strand may be between about 1-49 nt, or may be RISC length (e.g., about 15 to 25 nt) or Dicer substrate length (e.g., about 25 to 30 nt) such as disclosed herein.

Nucleic acid molecules with three or more strands include, for example, an 'A' (antisense) strand, 'S1' (second) strand, and 'S2' (third) strand in which the 'S1' and 'S2' strands are complementary to and form base pairs with non-overlapping regions of the 'A' strand (e.g., an mdRNA can have the form of A:S1S2). The S1, S2, or more strands together form what is substantially similar to a sense strand to the 'A' antisense strand. The double-stranded region formed by the annealing of the 'S1' and 'A' strands is distinct from and non-overlapping with the double-stranded region formed by the annealing of the 'S2' and 'A' strands. A nucleic acid molecule (e.g., an siNA molecule) may be a "gapped" molecule, meaning a "gap" ranging from 0 nt up to about 10 nt (e.g., 0, 1, 2, 3, 4, 5, 6, 7, 8, 9 or 10 nt). Preferably, the sense strand is gapped. In some embodiments, the A:S1 duplex is separated from the A:S2 duplex by a gap resulting from at least one unpaired nucleotide (up to about 10 unpaired nt) in the 'A' strand that is positioned between the A:S1 duplex and the A:S2 duplex and that is distinct from any one or more unpaired nucleotide at the 3'-end of one or more of the 'A', 'S1', or 'S2' strands. The A:S1 duplex may be separated from the A:B2 duplex by a gap of 0 nt (i.e., a nick in which only a phosphodiester bond between 2 nt is broken or missing in the polynucleotide molecule) between the A:S1 duplex and the A:S2 duplex-which can also be referred to as nicked dsRNA (ndsRNA). For example, A:S1S2 may include a dsRNA having at least two double-stranded regions that combined total about 14 base pairs to about 40 base pairs and the double-stranded regions are separated by a gap of about 0 to about 10 nt, optionally having blunt ends, or A:S1S2 may include a dsRNA having at least two double-stranded regions separated by a gap of up to 10 nt wherein at least one of the double-stranded regions includes between about five base pairs and thirteen base pairs.

Dicer Substrates

In certain embodiments, the nucleic acid molecules (e.g., siNA molecules) provided herein may be a precursor "Dicer substrate" molecule, e.g., double-stranded nucleic acid, processed in vivo to produce an active nucleic acid molecules, for example as described in Rossi, US20050244858. In certain conditions and situations, it has been found that these relatively longer dsRNA siNA species, e.g., of from about 25 to about 30 nt, can give unexpectedly effective results in terms of potency and duration of action. Without wishing to be bound by any particular theory, it is thought that the longer dsRNA species serve as a substrate for the enzyme Dicer in the cytoplasm of a cell. In addition to cleaving double-stranded nucleic acid into shorter segments, Dicer may facilitate the incorporation of a single-stranded cleavage product derived from the cleaved dsRNA into the RNA-induced silencing complex (RISC complex) that is responsible for the destruction of the cytoplasmic RNA derived from the target gene.

Dicer substrates may have certain properties which enhance its processing by Dicer. Dicer substrates are of a length sufficient such that it is processed by Dicer to produce an active nucleic acid molecule and may further include one or more of the following properties: (i) the dsRNA is asymmetric, e.g., has a 3'-overhang on the first strand (antisense strand) and (ii) the dsRNA has a modified 3'-end on the second strand (sense strand) to direct orientation of Dicer binding and processing of the dsRNA to an active siRNA. In certain embodiments, the longest strand in the Dicer substrate may be 24-30 nt.

Dicer substrates may be symmetric or asymmetric. The Dicer substrate may have a sense strand includes 22-28 nt and the antisense strand may include 24-30 nt; thus, in some embodiments the resulting Dicer substrate may have an overhang on the 3' end of the antisense strand. Dicer substrate may have a sense strand 25 nt in length, and the antisense strand having 27 nt in length with a two base 3'-overhang. The overhang may be 1-3 nt, for example 2 nt. The sense strand may also have a 5'-phosphate.

An asymmetric Dicer substrate may further contain two deoxynucleotides at the 3'-end of the sense strand in place of two of the ribonucleotides. Some exemplary Dicer substrates lengths and structures are 21+0, 21+2, 21−2, 22+0, 22+1, 22−1, 23+0, 23+2, 23−2, 24+0, 24+2, 24−2, 25+0, 25+2, 25−2, 26+0, 26+2, 26−2, 27+0, 27+2, and 27−2.

The sense strand of a Dicer substrate may be between about 22 to about 30 (e.g., about 22, 23, 24, 25, 26, 27, 28, 29 or 30); about 22 to about 28; about 24 to about 30; about 25 to about 30; about 26 to about 30; about 26 and 29; or about 27 to about 28 nt in length. In certain preferred embodiments Dicer substrates contain sense and antisense strands, that are at least about 25 nt in length and no longer than about 30 nt; between about 26 and 29 nt; or 27 nt in length. The sense and antisense strands may be the same length (blunt ended), different lengths (have overhangs), or a combination. The sense and antisense strands may exist on the same polynucleotide or on different polynucleotides. A Dicer substrate may have a duplex region of about 19, 20, 21, 22, 23, 24, 25 or 27 nt.

Like other siNA molecules provided herein, the antisense strand of a Dicer substrate may have any sequence that anneals to the antisense strand under biological conditions, such as within the cytoplasm of a eukaryotic cell.

Dicer substrates may have any modifications to the nucleotide base, sugar or phosphate backbone as known in the art and/or as described herein for other nucleic acid molecules (such as siNA molecules). In certain embodiments, Dicer substrates may have a sense strand modified for Dicer processing by suitable modifiers located at the 3'-end of the sense strand, i.e., the dsRNA is designed to direct orientation of Dicer binding and processing. Suitable modifiers include nucleotides such as deoxyribonucleotides, dideoxyribonucleotides, acyclo-nucleotides and the like and sterically hindered molecules, such as fluorescent molecules and the like. Acyclo-nucleotides substitute a 2-hydroxyethoxymethyl group for the 2'-deoxyribofuranosyl sugar normally present in dNMPs. Other nucleotides modifiers that could be used in Dicer substrate siNA molecules include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, they may replace ribonucleotides (e.g., 1-3 nucleotide modifiers, or 2 nucleotide modifiers are substituted for the ribonucleotides on the 3'-end of the sense strand) such that the length of the Dicer substrate does not change. When sterically hindered molecules are utilized, they may be attached to the ribonucleotide at the 3'-end of the antisense strand. Thus, in certain embodiments, the length of the strand does not change with the incorporation of the modifiers. In certain embodiments, two DNA bases in the dsRNA are substituted to direct the orientation of Dicer processing of the antisense strand. In a further embodiment, two terminal DNA bases are substituted for two ribonucleotides on the 3'-end of the sense strand forming a blunt end of the duplex on the 3'-end of the sense strand and the 5'-end of the antisense strand, and a two-nucleotide RNA overhang is located on the 3'-end of the antisense strand. This is an asymmetric composition with DNA on the blunt end and RNA bases on the overhanging end.

In certain embodiments, modifications are included in the Dicer substrate such that the modification does not prevent the nucleic acid molecule from serving as a substrate for Dicer. In one embodiment, one or more modifications are made that enhance Dicer processing of the Dicer substrate. One or more modifications may be made that result in more effective RNAi generation. One or more modifications may be made that support a greater RNAi effect. One or more modifications are made that result in greater potency per each Dicer substrate to be delivered to the cell. Modifications may be incorporated in the 3'-terminal region, the 5'-terminal region, in both the 3'-terminal and 5'-terminal region or at various positions within the sequence. Any number and combination of modifications can be incorporated into the Dicer substrate so long as the modification does not prevent the nucleic acid molecule from serving as a substrate for Dicer. Where multiple modifications are present, they may be the same or different. Modifications to bases, sugar moieties, the phosphate backbone, and their combinations are contemplated. Either 5'-terminus can be phosphorylated.

Examples of Dicer substrate phosphate backbone modifications include phosphonates, including methylphosphonate, phosphorothioate, and phosphotriester modifications such as alkylphosphotriesters, and the like. Examples of Dicer substrate sugar moiety modifications include 2'-alkyl pyrimidine, such as 2'OMe, 2'-fluoro, amino, and deoxy modifications and the like (see, e.g., Amarzguioui et al., 2003). Examples of Dicer substrate base group modifications include abasic sugars, 2'-O-alkyl modified pyrimidines, 4-thiouracil, 5-bromouracil, 5-iodouracil, and 5-(3-aminoallyl)-uracil and the like. LNAs could also be incorporated.

The sense strand may be modified for Dicer processing by suitable modifiers located at the 3'-end of the sense strand, i.e., the Dicer substrate is designed to direct orientation of Dicer binding and processing. Suitable modifiers include nucleotides such as deoxyribonucleotides, dideoxyribonucleotides, acyclo-nucleotides and the like and sterically hindered molecules, such as fluorescent molecules and the like. Acyclo-nucleotides substitute a 2-hydroxyethoxymethyl group for the 2'-deoxyribofuranosyl sugar normally present in dNMPs. Other nucleotides modifiers could include cordycepin, AZT, ddI, 3TC, d4T and the monophosphate nucleotides of AZT, 3TC and d4T. In one embodiment, deoxynucleotides are used as the modifiers. When nucleotide modifiers are utilized, 1-3 nucleotide modifiers, or 2 nucleotide modifiers are substituted for the ribonucleotides on the 3'-end of the sense strand. When sterically hindered molecules are utilized, they are attached to the ribonucleotide at the 3'-end of the antisense strand. Thus, the length of the strand does not change with the incorporation of the modifiers. In another embodiment, the description contemplates substituting two DNA bases in the Dicer substrate to direct the orientation of Dicer processing of the antisense strand. In a further embodiment of the present description, two terminal DNA bases are substituted for two ribonucleotides on the 3'-end of the sense strand forming a blunt end of the duplex on the 3'-end of the sense strand and the 5'-end of the antisense strand, and a two-nucleotide RNA overhang is located on the 3'-end of the antisense strand. This is an asymmetric composition with DNA on the blunt end and RNA bases on the overhanging end.

The antisense strand may be modified for Dicer processing by suitable modifiers located at the 3'-end of the antisense strand, i.e., the dsRNA is designed to direct orientation of Dicer binding and processing. Suitable modifiers include nucleotides such as deoxyribonucleotides, dideoxyribonucleotides, acyclo-nucleotides and the like and sterically hindered molecules, such as fluorescent molecules and the like. Acyclo-nucleotides substitute a 2-hydroxyethoxymethyl group for the 2'-deoxyribofuranosyl sugar normally present in dNMPs. Other nucleotides modifiers could include cordycepin, AZT, ddI, 3TC, d4T and the monophosphate nucleotides of AZT, 3TC and d4T. In one embodiment, deoxynucleotides are used as the modifiers. When nucleotide modifiers are utilized, 1-3 nucleotide modifiers, or 2 nucleotide modifiers are substituted for the ribonucleotides on the 3'-end of the antisense strand. When sterically hindered molecules are utilized, they are attached to the ribonucleotide at the 3'-end of the antisense strand. Thus, the length of the strand does not change with the incorporation of the modifiers. In another embodiment, the description contemplates substituting two DNA bases in the dsRNA to direct the orientation of Dicer processing. In a further description, two terminal DNA bases are located on the 3'-end of the antisense strand in place of two ribonucleotides forming a blunt end of the duplex on the 5'-end of the sense strand and the 3'-end of the antisense strand, and a two-nucleotide RNA overhang is located on the 3'-end of the sense strand. This is an asymmetric composition with DNA on the blunt end and RNA bases on the overhanging end.

Dicer substrates with a sense and an antisense strand can be linked by a third structure. The third structure will not block Dicer activity on the Dicer substrate and will not interfere with the directed destruction of the RNA transcribed from the target gene. The third structure may be a chemical linking group. Suitable chemical linking groups are known in the art and can be used. Alternatively, the third structure may be an oligonucleotide that links the two oligonucleotides of the dsRNA is a manner such that a hairpin structure is produced upon annealing of the two oligonucleotides making up the Dicer substrate. The hairpin structure preferably does not block Dicer activity on the Dicer substrate or interfere with the directed destruction of the RNA transcribed from the target gene.

The sense and antisense strands of the Dicer substrate are not required to be completely complementary. They only need to be substantially complementary to anneal under biological conditions and to provide a substrate for Dicer that produces a siRNA sufficiently complementary to the target sequence.

Dicer substrate can have certain properties that enhance its processing by Dicer. The Dicer substrate can have a length sufficient such that it is processed by Dicer to produce an active nucleic acid molecules (e.g., siRNA) and may have one or more of the following properties: the Dicer substrate is asymmetric, e.g., has a 3'-overhang on the first strand (antisense strand) and/or the Dicer substrate has a modified 3' end on the second strand (sense strand) to direct orientation of Dicer binding and processing of the Dicer substrate to an active siRNA. The Dicer substrate can be asymmetric such that the sense strand includes 22-28 nt and the antisense strand includes 24-30 nt. Thus, the resulting Dicer substrate has an overhang on the 3' end of the antisense strand. The overhang is 1-3 nt, for example 2 nt. The sense strand may also have a 5' phosphate.

A Dicer substrate may have an overhang on the 3'-end of the antisense strand and the sense strand is modified for Dicer processing. The 5'-end of the sense strand may have a phosphate. The sense and antisense strands may anneal under biological conditions, such as the conditions found in the cytoplasm of a cell. A region of one of the strands, particularly the antisense strand, of the Dicer substrate may have a sequence length of at least 19 nt, wherein these nucleotides are in the 21-nt region adjacent to the 3'-end of the antisense strand and are sufficiently complementary to a nucleotide sequence of the RNA produced from the target gene. A Dicer substrate may also have one or more of the following additional properties: the antisense strand has a right shift from a corresponding 21-mer (i.e., the antisense strand includes nucleotides on the right side of the molecule when compared to the corresponding 21-mer), the strands may not be completely complementary, i.e., the strands may contain simple mismatch pairings and base modifications such as LNA may be included in the 5'-end of the sense strand.

An antisense strand of a Dicer substrate nucleic acid molecule may be modified to include 1-9 ribonucleotides on the 5'-end to give a length of 22-28 nt. When the antisense strand has a length of 21 nt, then 1-7 ribonucleotides, or 2-5 ribonucleotides and or 4 ribonucleotides may be added on the 3'-end. The added ribonucleotides may have any sequence. Although the added ribonucleotides may be complementary to the target gene sequence, full complementarity between the target sequence and the antisense strands is not required. That is, the resultant antisense strand is sufficiently complementary with the target sequence. A sense strand may then have 24-30 nt. The sense strand may be substantially complementary with the antisense strand to anneal to the antisense strand under biological conditions. In one embodiment, the antisense strand may be synthesized to contain a modified 3'-end to direct Dicer processing. The sense strand may have a 3' overhang. The antisense strand may be synthesized to contain a modified 3'-end for Dicer binding and processing and the sense strand has a 3' overhang.

Heat Shock Protein 47

Heat shock protein 47 (HSP47) is a collagen-specific molecular chaperone and resides in the endoplasmic reticulum. It interacts with procollagen during the process of folding, assembling and transporting from the endoplasmic reticulum (Nagata Trends Biochem Sci 1996; 21:22-6; Razzaque et al. 2005; Contrib Nephrol 2005; 148: 57-69; Koide et al. 2006 J. Biol. Chem.; 281: 3432-38; Leivo et al. Dev. Biol. 1980; 76:100-114; Masuda et al. J. Clin. Invest. 1994; 94:2481-2488; Masuda et al. Cell Stress Chaperones 1998; 3:256-264). HSP47 upregulates expression in various tissue fibrosis (Koide et al. J Biol Chem 1999; 274: 34523-26), such as liver cirrhosis (Masuda et al. J Clin Invest 1994; 94:2481-8), pulmonary fibrosis (Razzaque et al. Virchows Arch 1998; 432:455-60; Kakugawa et al. Eur Respir J 2004; 24: 57-65), and glomerulosclerosis (Moriyama et al. Kidney Int 1998; 54: 110-19). Exemplary nucleic acid sequence of target human hsp47 cDNA is listed as SEQ ID NO:1. One of ordinary skill in the art would understand that a given sequence may change over time and to incorporate any changes needed in the nucleic acid molecules herein accordingly.

Methods and Compositions for Inhibiting hsp47

Provided are compositions and methods for inhibition of hsp47 expression by using small nucleic acid molecules, such as short interfering nucleic acid (siNA), interfering RNA (RNAi), short interfering RNA (siRNA), double-stranded RNA (dsRNA), micro-RNA (miRNA), and short hairpin RNA (shRNA) molecules capable of mediating or that mediate RNA interference against hsp47 gene expression. The composition and methods disclosed herein are also useful in treating various fibrosis such as liver fibrosis, lung fibrosis, and kidney fibrosis.

Nucleic acid molecule(s) and/or methods of the description are used to down regulate the expression of gene(s) that encode RNA referred to, by example, Genbank Accession NM_001235.

Compositions, methods and kits provided herein may include one or more nucleic acid molecules (e.g., siNA) and methods that independently or in combination modulate (e.g., downregulate) the expression of hsp47 protein and/or genes encoding hsp47 proteins, proteins and/or genes encoding hsp47, or an hsp47 gene family member where the genes or gene family sequences share sequence homology associated with the maintenance and/or development of diseases, conditions or disorders associated with hsp47, such as liver fibrosis, cirrhosis, pulmonary fibrosis, kidney fibrosis, peritoneal fibrosis, chronic hepatic damage, and fibrillogenesis. The description of the various aspects and embodiments is provided with reference to exemplary gene hsp47. However, the various aspects and embodiments are also directed to other related hsp47 genes, such as homolog genes and transcript variants, and polymorphisms (e.g., single nucleotide polymorphism, (SNPs)) associated with certain hsp47 genes. As such, the various aspects and embodiments are also directed to other genes that are involved in hsp47 mediated pathways of signal transduction or gene expression that are involved, for example, in the maintenance or development of diseases, traits, or conditions described herein. These additional genes can be analyzed for target sites using the methods described for the hsp47 gene herein. Thus, the modulation of other genes and the effects of such modulation of the other genes can be performed, determined, and measured as described herein.

In one embodiment, compositions and methods provided herein include a double-stranded short interfering nucleic acid (siNA) molecule that down-regulates expression of a hsp47 gene (e.g., human hsp47 exemplified by SEQ ID NO:1), where the nucleic acid molecule includes about 15 to about 49 base pairs.

In one embodiment, a nucleic acid disclosed may be used to inhibit the expression of the hsp47 gene or an hsp47 gene family where the genes or gene family sequences share sequence homology. Such homologous sequences can be identified as is known in the art, for example using sequence alignments. Nucleic acid molecules can be designed to target such homologous sequences, for example using perfectly complementary sequences or by incorporating non-canonical base pairs, for example mismatches and/or wobble base pairs that can provide additional target sequences. In instances where mismatches are identified, non-canonical base pairs (for example, mismatches and/or wobble bases) can be used to generate nucleic acid molecules that target more than one gene sequence. In a non-limiting example, non-canonical base pairs such as UU and CC base pairs are used to generate nucleic acid molecules that are capable of targeting sequences for differing hsp47 targets that share sequence homology. As such, one advantage of using siNAs disclosed herein is that a single nucleic acid can be designed to include nucleic acid sequence that is complementary to the nucleotide sequence that is conserved between the homologous genes. In this approach, a single nucleic acid can be used to inhibit expression of more than one gene instead of using more than one nucleic acid molecule to target the different genes.

Nucleic acid molecules may be used to target conserved sequences corresponding to a gene family or gene families such as hsp47 family genes. As such, nucleic acid molecules targeting multiple hsp47 targets can provide increased therapeutic effect. In addition, nucleic acid can be used to characterize pathways of gene function in a variety of applications. For example, nucleic acid molecules can be used to inhibit the activity of target gene(s) in a pathway to determine the function of uncharacterized gene(s) in gene function analysis, mRNA function analysis, or translational analysis. The nucleic acid molecules can be used to determine potential target gene pathways involved in various diseases and conditions toward pharmaceutical development. The nucleic acid molecules can be used to understand pathways of gene expression involved in, for example fibroses such as liver, kidney or pulmonary fibrosis, and/or inflammatory and proliferative traits, diseases, disorders, and/or conditions.

In one embodiment, the compositions and methods provided herein include a nucleic acid molecule having RNAi activity against hsp47 RNA, where the nucleic acid molecule includes a sequence complementary to any RNA having hsp47 encoding sequence, such as those sequences having sequences as shown in Table 3. In another embodiment, a nucleic acid molecule may have RNAi activity against hsp47 RNA, where the nucleic acid molecule includes a sequence complementary to an RNA having variant hsp47 encoding sequence, for example other mutant hsp47 genes not shown in Table 3 but known in the art to be associated with the maintenance and/or development of fibrosis. Chemical modifications as shown in Table 3 or otherwise described herein can be applied to any nucleic acid construct disclosed herein. In another embodiment, a nucleic acid molecule disclosed herein includes a nucleotide sequence that can interact with nucleotide sequence of a hsp47 gene and thereby mediate silencing of hsp47 gene expression, for example, wherein the nucleic acid molecule mediates regulation of hsp47 gene expression by cellular processes that modulate the chromatin structure or methylation patterns of the hsp47 gene and prevent transcription of the hsp47 gene.

Nucleic acid molecules disclosed herein may have RNAi activity against hsp47 RNA, where the nucleic acid molecule includes a sequence complementary to any RNA having hsp47 encoding sequence, such as those sequences having GenBank Accession Nos. NM_001235. Nucleic acid molecules may have RNAi activity against hsp47 RNA, where the nucleic acid molecule includes a sequence complementary to an RNA having variant hsp47 encoding sequence, for example other mutant hsp47 genes known in the art to be associated with the maintenance and/or development of fibrosis.

Nucleic acid molecules disclosed herein include a nucleotide sequence that can interact with nucleotide sequence of a hsp47 gene and thereby mediate silencing of hsp47 gene expression, e.g., where the nucleic acid molecule mediates regulation of hsp47 gene expression by cellular processes that modulate the chromatin structure or methylation patterns of the hsp47 gene and prevent transcription of the hsp47 gene.

Methods of Treatment

The specific association of HSP47 with a diverse range of collagen types makes hsp47 a target for the treatment of fibrosis. Inhibition of hsp47 expression may prevent extracellular collagen I secretion. Sato et al. (Nat Biotechnol 2008; 26:431-442) explored this possibility by using siRNA for the inhibition of hsp47 expression and preventing the progression of hepatic fibrosis in rats. Similarly, Chen et al. (Br J Dermatol 2007; 156: 1188-1195) and Wang et al. (Plast Reconstr Surg 2003; 111: 1980-7) investigated the inhibition hsp47 expression by RNA interference technology.

In one embodiment, nucleic acid molecules may be used to down regulate or inhibit the expression of hsp47 and/or hsp47 proteins arising from hsp47 and/or hsp47 haplotype polymorphisms that are associated with a disease or condition, (e.g., fibrosis). Analysis of hsp47 and/or hsp47 genes, or hsp47 and/or hsp47 protein or RNA levels can be used to identify subjects with such polymorphisms or those subjects who are at risk of developing traits, conditions, or diseases described herein. These subjects are amenable to treatment, for example, treatment with nucleic acid molecules disclosed herein and any other composition useful in treating diseases related to hsp47 and/or hsp47 gene expression. As such, analysis of hsp47 and/or hsp47 protein or RNA levels can be used to determine treatment type and the course of therapy in treating a subject. Monitoring of hsp47 and/or hsp47 protein or RNA levels can be used to predict treatment outcome and to determine the efficacy of compounds and compositions that modulate the level and/or activity of certain hsp47 and/or hsp47 proteins associated with a trait, condition, or disease.

Provided are compositions and methods for inhibition of hsp47 expression by using small nucleic acid molecules as provided herein, such as siNA, RNAi, siRNA, double-stranded RNA (dsRNA), micro-RNA (miRNA), and short hairpin RNA (shRNA) molecules capable of mediating or that mediate RNA interference against hsp47 gene expression. The composition and methods disclosed herein are also useful in treating various fibrosis such as liver fibrosis, lung fibrosis, and kidney fibrosis.

The nucleic acid molecules disclosed herein individually, or in combination or in conjunction with other drugs, can be used for preventing or treating diseases, traits, conditions and/or disorders associated with hsp47, such as liver fibrosis, cirrhosis, pulmonary fibrosis, kidney fibrosis, peritoneal fibrosis, chronic hepatic damage, and fibrillogenesis.

The nucleic acid molecules disclosed herein are able to inhibit the expression of hsp47 in a sequence specific manner. The nucleic acid molecules may include a sense strand and an antisense strand which include contiguous nucleotides that are at least partially complementary (antisense) to an hsp47 mRNA.

In some embodiments, dsRNA specific for hsp47 can be used in conjunction with other dsRNA specific for other molecular chaperones that assist in the folding of newly synthesized proteins such as, calnexin, calreticulin, and/or BiP (Bergeron et al. Trends Biochem. Sci. 1994; 19:124-128; Herbert et al. 1995; Cold Spring Harb. Symp. Quant. Biol. 60:405-415).

In another aspect, provided are methods for reducing the expression of hsp47 in a cell by introducing into a cell a nucleic acid molecule as provided herein in an amount sufficient to reduce expression of hsp47. In one embodiment, the cell is hepatic stellate cell. In another embodiment, the cell is a stellate cell in renal or pulmonary tissue. In certain embodiment, the method is performed in vitro. In another embodiment, the method is performed in vivo.

In another aspect, provided are methods for treating an individual suffering from a disease associated with hsp47. The methods include administering to the individual a nucleic acid molecule such as provided herein in an amount sufficient to reduce expression of hsp47. In certain embodiments, the disease associated with hsp47 is a disease selected from the group consisting of liver fibrosis, cirrhosis, pulmonary fibrosis including lung fibrosis (including ILF), any condition causing kidney fibrosis (e.g., CKD including ESRD), peritoneal fibrosis, chronic hepatic damage, fibrillogenesis; fibrotic diseases in other organs; abnormal scarring (keloids) associated with all possible types of skin injury, accidental and iatrogenic (operations), scleroderma, cardiofibrosis, failure of glaucoma filtering operation, and intestinal adhesions. In some embodiments, the compounds may be useful in treating organ-specific indications, for example, indications including those shown in Table 1 below, listing organs and respective indications:

TABLE 1

Skin

Pathologic scarring as keloid and hypertrophic scar
Surgical scarring
Injury scarring
keloid, or nephrogenic fibrosing dermatopathy Peritoneum Peritoneal fibrosis
Adhesions
Peritoneal Sclerosis associated with continual ambulatory peritoneal dialysis (CAPD)

Liver

Cirrhosis including post-hepatitis C cirrhosis, primary biliary cirrhosis
Liver fibrosis, e.g. Prevention of Liver Fibrosis in Hepatitis C carriers
schistomasomiasis
cholangitis
Liver cirrhosis due to Hepatitis C post liver transplant or Non-Alcoholic Steatohepatitis (NASH)

Pancreas inter(peri)lobular fibrosis (e.g., alcoholic chronic pancreatitis), periductal fibrosis (e.g., hereditary pancreatitis), periductal and interlobular fibrosis (e.g., autoimmune pancreatitis), diffuse inter- and intralobular fibrosis (e.g., obstructive chronic pancreatitis)

Kidney

Chronic Kidney Disease (CKD) of any etiology. Treatment of early stage CKD (elevated SCr) in diabetic patients (prevent further deterioration in renal function)
kidney fibrosis associated with lupus glomeruloschelerosis
Diabetic Nephropathy TABLE 1-continued Heart Congestive heart failure,
Endomyocardial fibrosis,
cardiofibrosis
fibrosis associated with myocardial infarction Lung Asthma, Idiopathic pulmonary fibrosis (IPF);
Interstitial lung fibrosis (ILF)
Radiation Pneumonitis leading to Pulmonary Fibrosis (e.g. due to cancer treating radiation)

Bone marrow

Myeloproliferative disorders: Myelofibrosis (MF), Polycythemia vera (PV), Essential thrombocythemia (ET)
idiopathic myelofibrosis
drug induced myelofibrosis.

Eye

Anterior segment: Corneal opacification e,g, following inherited dystrophies, herpetic keratitis or pterygia; Glaucoma
Posterior segment fibrosis and traction retinal detachment, a complication of advanced diabetic retinopathy (DR); Fibrovascular scarring and gliosis in the retina;
Under the retina fibrosis for example subsequent to subretinal hemorrhage associated with neovascular AMD
Retro-orbital fibrosis, postcataract surgery, proliferative vitreoretinopathy.
Ocular cicatricial pemphigoid Intestine Intestinal fibrosis,
Crohn's disease Vocal cord Vocal cord scarring,
vocal cord mucosal fibrosis,
laryngeal fibrosis Vasculature Atherosclerosis,
postangioplasty arterial restenosis Multisystemic Scleroderma systemic sclerosis;
multifocal fibrosclerosis;
sclerodermatous graft-versus-host disease in bone marrow transplant recipients, and
nephrogenic systemic fibrosis (exposure to gadolinium-based contrast agents (GBCAs), 30% of MRIs)

Malignancies of various origin

Metastatic and invasive cancer by inhibiting function of activated tumor associated myofibroblasts Another embodiment of the description is a method for treating a stellate cell-related disorder, the method comprising administering an effective amount of the pharmaceutical composition described infra to a subject in need thereof. The disorder includes hepatitis, hepatic fibrosis, hepatic cirrhosis, liver cancer, pancreatitis, pancreatic fibrosis, pancreatic cancer, vocal cord scarring, vocal cord mucosal fibrosis, and laryngeal fibrosis. In some embodiments the preferred indications include, liver cirrhosis due to Hepatitis C post liver transplant; liver cirrhosis due to Non-Alcoholic Steatohepatitis (NASH); idiopathic pulmonary fibrosis; radiation pneumonitis leading to pulmonary fibrosis; diabetic nephropathy; peritoneal sclerosis associated with continual ambulatory peritoneal dialysis (CAPD) and ocular cicatricial pemphigoid.

Fibrotic liver indications include alcoholic cirrhosis, hepatitis B cirrhosis, hepatitis C cirrhosis, hepatitis C (Hep C) cirrhosis post-orthotopic liver transplant (OLTX), non-alcoholic steatohepatitis/nonalcoholic fatty liver disease (NASH/NAFLD), primary biliary cirrhosis (PBC), primary sclerosing cholangitis (PSC), biliary atresia, alpha-1 antitrypsin deficiency (A1AD), copper storage diseases (Wilson's disease), fructosemia, galactosemia, glycogen storage diseases (especially types III, IV, VI, IX, and X), iron-overload syndromes (hemochromatosis), lipid abnormalities (e.g., Gaucher's disease), peroxisomal disorders (e.g., Zellweger syndrome), tyrosinemia, congenital hepatic fibrosis, bacterial Infections (e.g., brucellosis), parasitic (e.g., echinococcosis), Budd-Chiari syndrome (hepatic veno-occlusive disease).

Pulmonary indications include Idiopathic Pulmonary Fibrosis, Silicosis, Pneumoconiosis, bronchopulmonary dysplasia in newborn following neonatal respiratory distress syndrome, bleomycin/chemolung injury, bronchiolitis obliterans (BOS) Post-lung transplant, Chronic obstructive pulmonary disorder (COPD), cystic fibrosis, and asthma.

Cardiac indications include cardiomyopathy, atherosclerosis (Bergers disease, etc), endomyocardial fibrosis, atrial fibrillation, scarring post-myocardial infarction (MI).

Other thoracic indications include radiation-induced capsule tissue reactions around textured breast implants, and oral submucosal fibrosis.

Renal indications include autosomal dominant polycystic kidney disease (ADPKD), Diabetic nephropathy (diabetic glomerulosclerosis), focal segmental glomerulosclerosis (FSGS) (collapsing vs. other histologic variants), IgA Nephropathy (Berger Disease), Lupus Nephritis, Wegener's, Scleroderma, Goodpasture Syndrome, tubulointerstitial fibrosis: drug induced (protective) pencillins, cephalosporins, analgesic nephropathy, membrano-proliferative glomerulonephritis (MPGN), Henoch-Schonlein purpura, Congenital nephropathies: Medullary Cystic Dise2ase, Nail-Patella Syndrome and Alport Syndrome.

Bone Marrow indications include lymphangioleiomyositosis (LAM), chronic graft vs. host disease, polycythemia vera, essential thrombocythemia, and myelofibrosis.

Ocular indications include retinopathy of prematurity (RoP), ocular cicatricial pemphigoid, lacrimal gland fibrosis, retinal attachment surgery, corneal opacity, herpetic keratitis, pterygia, glaucoma, age-related macular degeneration (AMD/ARMD), retinal fibrosis associated diabetes mellitus (DM) retinopathy.

Gynecological indications include Endometriosis add on to hormonal therapy for prevention of scarring, post-STD fibrosis/salpingitis.

Systemic indications include Dupuytren's disease, Palmar fibromatosis, Peyronie's disease, Ledderhose disease, keloids, multifocal fibrosclerosis, nephrogenic systemic fibrosis and myelofibrosis (anemia).

Injury-associated fibrotic diseases include burn-induced (chemical included) skin and soft tissue scarring and contraction, radiation-induced skin and organ scarring, post cancer therapeutic radiation treatment, keloid (skin).

Surgical indications include peritoneal fibrosis post-peritoneal dialysis catheter, corneal implant, cochlear implant, other implants, silicone implants in breasts, chronic sinusitis; adhesions, pseudointimal hyperplasia of dialysis grafts.

Other indications include chronic pancreatitis.

In some embodiments, provided is a method for treatment of a subject suffering from liver fibrosis comprising administering to the subject an effective amount of a nucleic acid molecule disclosed herein, thereby treating liver fibrosis. In some embodiments, the subject is suffering from cirrhosis of the liver due to hepatitis. In some embodiments, the subject is suffering from cirrhosis of the liver due to NASH.

In some embodiments, provided is the use of a nucleic acid molecule disclosed herein for the manufacture of a medicament to treat liver fibrosis. In some embodiments, the liver fibrosis is due to hepatitis. In some embodiments, the liver fibrosis is due to NASH.

In some embodiments, provided is a method for remodeling of scar tissue comprising administering to a subject in need thereof an effective amount of a nucleic acid molecule disclosed herein, thereby effecting scar tissue remodeling. In some embodiments, the scar tissue is in the liver. In some embodiments, the subject is suffering from cirrhosis of the liver due to hepatitis. In some embodiments, the subject is suffering from cirrhosis of the liver due to NASH.

In some embodiments, a method for modulating fibrosis regression is provided comprising administering to a subject in need thereof an effective amount of a nucleic acid molecule disclosed herein, thereby effecting fibrosis regression.

In some embodiments, provided is a method for reduction of scar tissue in a subject comprising the step of administering to the subject an effective amount of a nucleic acid molecule disclosed herein to reduce the scar tissue. In some embodiments, provided is a method for reducing scar tissue in a subject comprising the step of topically applying to scar tissue an effective amount of a nucleic acid molecule disclosed herein to reduce scar tissue.

In some embodiments, provided is a method for improving the appearance of scar tissue comprising the step of topically applying to scar tissue an effective amount of a nucleic acid molecule disclosed herein to improve the appearance of the scar tissue.

In some embodiments, provided is a method for treatment of a subject suffering from lung fibrosis comprising administering to the subject an effective amount of a nucleic acid molecule disclosed herein, thereby treating the lung fibrosis. In some embodiments, the subject is suffering from interstitial lung fibrosis (ILF). In some embodiments, the subject is suffering from Radiation Pneumonitis leading to Pulmonary Fibrosis. In some embodiments, the subject is suffering from drug induced lung fibrosis.

In some embodiments, provided is the use of a nucleic acid molecule disclosed herein for the manufacture of a medicament to treat lung fibrosis. In some embodiments, the lung fibrosis is ILF. In some embodiments, the lung fibrosis is drug- or radiation-induced lung fibrosis.

Fibrosis can be treated by RNA interference using nucleic acid molecules as disclosed herein. Exemplary fibroses include liver fibrosis, peritoneal fibrosis, lung fibrosis, kidney fibrosis. The nucleic acid molecules disclosed herein may inhibit the expression of hsp47 in a sequence specific manner.

Treatment of fibrosis can be monitored by determining the level of extracellular collagen using suitable techniques known in the art such as, using anti-collagen I antibodies. Treatment can also be monitored by determining the level of hsp47 mRNA or the level of HSP47 protein in the cells of the affected tissue. Treatment can also be monitored by non-invasive scanning of the affected organ or tissue such as by computer assisted tomography scan, magnetic resonance elastography scans.

A method for treating or preventing hsp47 associated disease or condition in a subject or organism may include contacting the subject or organism with a nucleic acid molecule as provided herein under conditions suitable to modulate the expression of the hsp47 gene in the subject or organism.

A method for treating or preventing fibrosis in a subject or organism may include contacting the subject or organism with a nucleic acid molecule under conditions suitable to modulate the expression of the hsp47 gene in the subject or organism.

A method for treating or preventing one or more fibroses selected from the group consisting of liver fibrosis, kidney fibrosis, and pulmonary fibrosis in a subject or organism may include contacting the subject or organism with a nucleic acid molecule under conditions suitable to modulate the expression of the hsp47 gene in the subject or organism.

Fibrotic Diseases

Fibrotic diseases are generally characterized by the excess deposition of a fibrous material within the extracellular matrix, which contributes to abnormal changes in tissue architecture and interferes with normal organ function.

All tissues damaged by trauma respond by the initiation of a wound-healing program. Fibrosis, a type of disorder characterized by excessive scarring, occurs when the normal self-limiting process of wound healing response is disturbed, and causes excessive production and deposition of collagen. As a result, normal organ tissue is replaced with scar tissue, which eventually leads to the functional failure of the organ.

Fibrosis may be initiated by diverse causes and in various organs. Liver cirrhosis, pulmonary fibrosis, sarcoidosis, keloids and kidney fibrosis are all chronic conditions associated with progressive fibrosis, thereby causing a continuous loss of normal tissue function.

Acute fibrosis (usually with a sudden and severe onset and of short duration) occurs as a common response to various forms of trauma including accidental injuries (particularly injuries to the spine and central nervous system), infections, surgery, ischemic illness (e.g. cardiac scarring following heart attack), burns, environmental pollutants, alcohol and other types of toxins, acute respiratory distress syndrome, radiation and chemotherapy treatment.

Fibrosis, a fibrosis related pathology or a pathology related to aberrant crosslinking of cellular proteins may all be treated by the siRNAs disclosed herein. Fibrotic diseases or diseases in which fibrosis is evident (fibrosis related pathology) include both acute and chronic forms of fibrosis of organs, including all etiological variants of the following: pulmonary fibrosis, including interstitial lung disease and fibrotic lung disease, liver fibrosis, cardiac fibrosis including myocardial fibrosis, kidney fibrosis including chronic renal failure, skin fibrosis including scleroderma, keloids and hypertrophic scars; myelofibrosis (bone marrow fibrosis); all types of ocular scarring including proliferative vitreoretinopathy (PVR) and scarring resulting from surgery to treat cataract or glaucoma; inflammatory bowel disease of variable etiology, macular degeneration, Grave's ophthalmopathy, drug induced ergotism, keloid scars, scleroderma, psoriasis, glioblastoma in Li-Fraumeni syndrome, sporadic glioblastoma, myleoid leukemia, acute myelogenous leukemia, myelodysplastic syndrome, myeloproferative syndrome, gynecological cancer, Kaposi's sarcoma, Hansen's disease, and collagenous colitis.

In various embodiments, the compounds (nucleic acid molecules) as disclosed herein may be used to treat fibrotic diseases, for example as disclosed herein, as well as many other diseases and conditions apart from fibrotic diseases, for example such as disclosed herein. Other conditions to be treated include fibrotic diseases in other organs-kidney fibrosis for any reason (CKD including ESRD); lung fibrosis (including ILF); myelofibrosis, abnormal scarring (keloids) associated with all possible types of skin injury accidental and jatrogenic (operations); scleroderma; cardiofibrosis, failure of glaucoma filtering operation; intestinal adhesions.

Ocular Surgery and Fibrotic Complications

Contracture of scar tissue resulting from eye surgery may often occur. Glaucoma surgery to create new drainage channels often fails due to scarring and contraction of tissues and the generated drainage system may be blocked requiring additional surgical intervention. Current anti-scarring regimens (mitomycin C or 5FU) are limited due to the complications involved (e.g. blindness). There may also be contraction of scar tissue formed after corneal trauma or corneal surgery, for example laser or surgical treatment for myopia or refractive error in which contraction of tissues may lead to inaccurate results. Scar tissue may be formed on/in the vitreous humor or the retina, for example, and may eventually causes blindness in some diabetics, and may be formed after detachment surgery, called proliferative vitreoretinopathy (PVR). PVR is the most common complication following retinal detachment and is associated with a retinal hole or break. PVR refers to the growth of cellular membranes within the vitreous cavity and on the front and back surfaces of the retina containing retinal pigment epithelial (RPE) cells. These membranes, which are essentially scar tissues, exert traction on the retina and may result in recurrences of retinal detachment, even after an initially successful retinal detachment procedure.

Scar tissue may be formed in the orbit or on eye and eyelid muscles after squint, orbital or eyelid surgery, or thyroid eye disease, and where scarring of the conjunctiva occurs as may happen after glaucoma surgery or in cicatricial disease, inflammatory disease, for example, pemphigoid, or infective disease, for example, trachoma. A further eye problem associated with the contraction of collagen-including tissues is the opacification and contracture of the lens capsule after cataract extraction. Important role for MMPs has been recognized in ocular diseases including wound healing, dry eye, sterile corneal ulceration, recurrent epithelial erosion, corneal neovascularization, pterygium, conjunctivochalasis, glaucoma, PVR, and ocular fibrosis.

Liver Fibrosis

Liver fibrosis (LF) is a generally irreversible consequence of hepatic damage of several etiologies. In the Western world, the main etiologic categories are: alcoholic liver disease (30-50%), viral hepatitis (30%), biliary disease (5-10%), primary hemochromatosis (5%), and drug-related and cryptogenic cirrhosis of, unknown etiology, (10-15%). Wilson's disease, $\alpha_1$-antitrypsin deficiency and other rare diseases also have liver fibrosis as one of the symptoms. Liver cirrhosis, the end stage of liver fibrosis, frequently requires liver transplantation and is among the top ten causes of death in the Western world.

Kidney Fibrosis and Related Conditions

Chronic Renal Failure (CRF)

Chronic renal failure is a gradual and progressive loss of the ability of the kidneys to excrete wastes, concentrate urine, and conserve electrolytes. CRF is slowly progressive. It most often results from any disease that causes gradual loss of kidney function, and fibrosis is the main pathology that produces CRF.

Diabetic Nephropathy

Diabetic nephropathy, hallmarks of which are glomerulosclerosis and tubulointerstitial fibrosis, is the single most prevalent cause of end-stage renal disease in the modern world, and diabetic patients constitute the largest population on dialysis. Such therapy is costly and far from optimal. Transplantation offers a better outcome but suffers from a severe shortage of donors.

Chronic Kidney Disease

Chronic kidney disease (CKD) is a worldwide public health problem and is recognized as a common condition that is associated with an increased risk of cardiovascular disease and chronic renal failure (CRF).

The Kidney Disease Outcomes Quality Initiative (K/DOQI) of the National Kidney Foundation (NKF) defines chronic kidney disease as either kidney damage or a decreased kidney glomerular filtration rate (GFR) for three or more months. Other markers of CKD are also known and used for diagnosis. In general, the destruction of renal mass with irreversible sclerosis and loss of nephrons leads to a progressive decline in GFR. Recently, the K/DOQI published a classification of the stages of CKD, as follows:

Stage 1: Kidney damage with normal or increased GFR (>90 mL/min/1.73 m2)

Stage 2: Mild reduction in GFR (60-89 mL/min/1.73 m2)

Stage 3: Moderate reduction in GFR (30-59 mL/min/1.73 m2)

Stage 4: Severe reduction in GFR (15-29 mL/min/1.73 m2)

Stage 5: Kidney failure (GFR<15 mL/min/1.73 m2 or dialysis)

In stages 1 and 2 CKD, GFR alone does not confirm the diagnosis. Other markers of kidney damage, including abnormalities in the composition of blood or urine or abnormalities in imaging tests, may be relied upon.

Pathophysiology of CKD

Approximately 1 million nephrons are present in each kidney, each contributing to the total GFR. Irrespective of the etiology of renal injury, with progressive destruction of nephrons, the kidney is able to maintain GFR by hyperfiltration and compensatory hypertrophy of the remaining healthy nephrons. This nephron adaptability allows for continued normal clearance of plasma solutes so that substances such as urea and creatinine start to show significant increases in plasma levels only after total GFR has decreased to 50%, when the renal reserve has been exhausted. The plasma creatinine value will approximately double with a 50% reduction in GFR. Therefore, a doubling in plasma creatinine from a baseline value of 0.6 mg/dL to 1.2 mg/dL in a patient actually represents a loss of 50% of functioning nephron mass.

The residual nephron hyperfiltration and hypertrophy, although beneficial for the reasons noted, is thought to represent a major cause of progressive renal dysfunction. This is believed to occur because of increased glomerular capillary pressure, which damages the capillaries and leads initially to focal and segmental glomerulosclerosis and eventually to global glomerulosclerosis. This hypothesis has been based on studies of five-sixths nephrectomized rats, which develop lesions that are identical to those observed in humans with CKD.

The two most common causes of chronic kidney disease are diabetes and hypertension. Other factors include acute insults from nephrotoxins, including contrasting agents, or decreased perfusion; proteinuria; increased renal ammoniagenesis with interstitial injury; hyperlipidemia; Hyperphosphatemia with calcium phosphate deposition; decreased levels of nitrous oxide and smoking.

In the United States, the incidence and prevalence of CKD is rising, with poor outcomes and high cost to the health system. Kidney disease is the ninth leading cause of death in the US. The high rate of mortality has led the US Surgeon General's mandate for America's citizenry, Healthy People 2010, to contain a chapter focused on CKD. The objectives of this chapter are to articulate goals and to provide strategies to reduce the incidence, morbidity, mortality, and health costs of chronic kidney disease in the United States.

The incidence rates of end-stage renal disease (ESRD) have also increased steadily internationally since 1989. The United States has the highest incident rate of ESRD, followed by Japan. Japan has the highest prevalence per million population followed by the United States.

The mortality rates associated with hemodialysis are striking and indicate that the life expectancy of patients entering into hemodialysis is markedly shortened. At every age, patients with ESRD on dialysis have significantly increased mortality when compared with nondialysis patients and individuals without kidney disease. At age 60 years, a healthy person can expect to live for more than 20 years, whereas the life expectancy of a 60-year-old patient starting hemodialysis is closer to 4 years.

Pulmonary Fibrosis

Interstitial pulmonary fibrosis (IPF) is scarring of the lung caused by a variety of inhaled agents including mineral particles, organic dusts, and oxidant gases, or by unknown reasons (idiopathic lung fibrosis). The disease afflicts millions of individuals worldwide, and there are no effective therapeutic approaches. A major reason for the lack of useful treatments is that few of the molecular mechanisms of disease have been defined sufficiently to design appropriate targets for therapy.

Cardiac Fibrosis

Heart failure is unique among the major cardiovascular disorders in that it alone is increasing in prevalence while there has been a striking decrease in other conditions. Some of this can be attributed to the aging of the populations of the United States and Europe. The ability to salvage patients with myocardial damage is also a major factor, as these patients may develop progression of left ventricular dysfunction due to deleterious remodelling of the heart.

The normal myocardium is composed of a variety of cells, cardiac myocytes and noncardiomyocytes, which include endothelial and vascular smooth muscle cells and fibroblasts.

Structural remodeling of the ventricular wall is a key determinant of clinical outcome in heart disease. Such remodeling involves the production and destruction of extracellular matrix proteins, cell proliferation and migration, and apoptotic and necrotic cell death. Cardiac fibroblasts are crucially involved in these processes, producing growth factors and cytokines that act as autocrine and paracrine factors, as well as extracellular matrix proteins and proteinases. Recent studies have shown that the interactions between cardiac fibroblasts and cardiomyocytes are essential for the progression of cardiac remodeling of which the net effect is deterioration in cardiac function and the onset of heart failure.

Burns and Scars

A particular problem which may arise, particularly in fibrotic disease, is contraction of tissues, for example contraction of scars. Contraction of tissues including extracellular matrix components, especially of collagen-including tissues, may occur in connection with many different pathological conditions and with surgical or cosmetic procedures. Contracture, for example, of scars, may cause physical problems, which may lead to the need for medical treatment, or it may cause problems of a purely cosmetic nature. Collagen is the major component of scar and other contracted tissue and as such is the most important structural component to consider. Nevertheless, scar and other contracted tissue also include other structural components, especially other extracellular matrix components, for example, elastin, which may also contribute to contraction of the tissue.

Contraction of collagen-including tissue, which may also include other extracellular matrix components, frequently occurs in the healing of burns. The burns may be chemical, thermal or radiation burns and may be of the eye, the surface of the skin or the skin and the underlying tissues. It may also be the case that there are burns on internal tissues, for example, caused by radiation treatment. Contraction of burnt tissues is often a problem and may lead to physical and/or cosmetic problems, for example, loss of movement and/or disfigurement.

Skin grafts may be applied for a variety of reasons and may often undergo contraction after application. As with the healing of burnt tissues the contraction may lead to both physical and cosmetic problems. It is a particularly serious problem where many skin grafts are needed as, for example, in a serious burns case.

Contraction is also a problem in production of artificial skin. To make a true artificial skin it is necessary to have an epidermis made of epithelial cells (keratinocytes) and a dermis made of collagen populated with fibroblasts. It is important to have both types of cells because they signal and stimulate each other using growth factors. The collagen component of the artificial skin often contracts to less than one tenth of its original area when populated by fibroblasts.

Cicatricial contraction, contraction due to shrinkage of the fibrous tissue of a scar, is common. In some cases the scar may become a vicious cicatrix, a scar in which the contraction causes serious deformity. A patient's stomach may be effectively separated into two separate chambers in an hour-glass contracture by the contraction of scar tissue formed when a stomach ulcer heals. Obstruction of passages and ducts, cicatricial stenosis, may occur due to the contraction of scar tissue. Contraction of blood vessels may be due to primary obstruction or surgical trauma, for example, after surgery or angioplasty. Stenosis of other hollow viscus, for examples, ureters, may also occur. Problems may occur where any form of scarring takes place, whether resulting from accidental wounds or from surgery. Conditions of the skin and tendons which involve contraction of collagen-including tissues include post-trauma conditions resulting from surgery or accidents, for example, hand or foot tendon injuries, post-graft conditions and pathological conditions, such as scleroderma, Dupuytren's contracture and epidermolysis bullosa. Scarring and contraction of tissues in the eye may occur in various conditions, for example, the sequelae of retinal detachment or diabetic eye disease (as mentioned above). Contraction of the sockets found in the skull for the eyeballs and associated structures, including extra-ocular muscles and eyelids, may occur if there is trauma or inflammatory damage. The tissues contract within the sockets causing a variety of problems including double vision and an unsightly appearance.

For further information on different types of fibrosis see: Molina V, et al., 2002, Harefuah, 141: 973-8, 1009; Yu, et al., 2002, Curr Opin Pharmacol. 2(2):177-81; Keane, et al., 2003, Am J Kidney Dis. 41: S22-5; Bohle, et al., 1989, Pathol Res Pract. 185:421-40; Kikkawa, et al., 1997, Kidney Int Suppl. 62:S39-40; Bataller et al., 2001, Semin Liver Dis. 21:437-51; Gross, et al., 2001 N Engl J Med. 345:517-25; Frohlich, 2001, Am J Hypertens; 14:1945-1995; Friedman, 2003, J Hepatol. 38:S38-53; Albanis, et al., 2003, Curr Gastroenterol Rep. 5:48-56; Weber, 2000, Curr Opin Cardiol. 15:264-72).

Delivery of Nucleic Acid Molecules and Pharmaceutical Formulations

Within the scope of the description are compounds of formula I

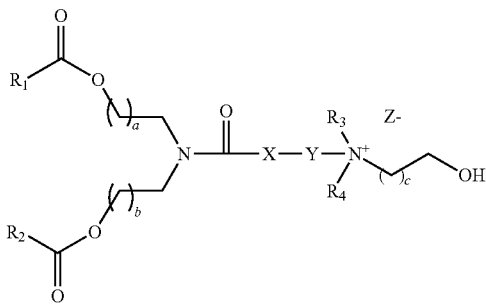

wherein $R_1$ and $R_2$ are independently selected from $C_{10}$ to $C_{18}$ alkyl, $C_{12}$ to $C_{18}$ alkenyl, and oleoyl; $R_3$ and $R_4$ are independently selected from $C_1$ to $C_6$ alkyl and $C_2$ to $C_6$ alkanol; X is selected from —$CH_2$—, —S—, and —O—, or X is absent; Y is selected from —$(CH_2)_n$—, —$S(CH_2)_n$—, —$O(CH_2)_n$—, -thiophene-, —$SO_2(CH_2)_n$—, and -ester-; n=1-4; a=1-4; b=1-4; c=1-4; and $Z^-$ is a counterion.

Compounds of the description herein are also referred to herein as being within the class of compounds known as "cationic lipids." Cationic lipids are compounds that include at least one lipid moiety and positively charged nitrogen associated with a counterion. "Lipids" are understood in the art to be comprised of a hydrophobic alkyl or alkenyl moiety and a carboxylic acid or ester moiety.

It has heretofore been discovered that the amino-alkyl-hydroxyl (—N-alkyl-OH) moiety of the compounds of formula I imparts properties to the formulations of the description herein not previously seen with other cationic lipids previously reported. Formulations of the description herein include compounds of formula I result in superior reduction in protein expression, as compared to formulations that do not include compounds of formula I. Particularly surprising is the ability of formulations of the description herein that include compounds of formula I to reduce the expression of HSP47.

Preferred compounds of the description herein include those wherein $R_1$ and $R_2$ are each independently $C_{10}$-$C_{30}$ alkyl. In more preferred embodiments, $R_1$ and $R_2$ are each independently $C_{10}$-$C_{20}$ alkyl. In even more preferred embodiments, $R_1$ and $R_2$ are each independently $C_{12}$-$C_{18}$ alkyl. Particularly preferred embodiments include those wherein $R_1$ and $R_2$ are each independently $C_{13}$-$C_{17}$ alkyl. Most preferred are those compounds wherein $R_1$ and $R_2$ are each $C_{13}$ alkyl.

In other embodiments, $R_1$ and $R_2$ are each independently $C_{10}$-$C_{30}$ alkenyl. In more preferred embodiments, $R_1$ and $R_2$ are each independently $C_{10}$-$C_{20}$ alkenyl. In still other embodiments, $R_1$ and $R_2$ are each independently $C_{12}$-$C_{18}$ alkenyl. In yet other embodiments, $R_1$ and $R_2$ are each independently $C_{13}$-$C_{17}$ alkenyl. Most preferred compounds of the description herein include those wherein $R_1$ and $R_2$ are each $C_{17}$ alkenyl.

Also for compounds of formula I, $R_3$ and $R_4$ are independently selected from $C_1$ to $C_6$ alkyl. In preferred embodiments, $R_3$ and $R_4$ are each independently $C_1$-$C_3$ alkyl. Most preferably, $R_3$ and $R_4$ are each methyl. In other embodiments, at least one of $R_3$ and $R_4$ are —$CH_2CH_2OH$.

Most preferred are those compounds of formula I, wherein a, b, and c are all 1.

Z can be any nitrogen counterion, as that term is readily understood in the art. Preferred nitrogen counterions include halogens, with chloride and bromide being particularly preferred and mesylate ($SO_3CH_3^-$). In contrast to other cationic lipids previously described wherein the effect of the cationic lipid depends on the counterion, the efficacy of compounds of formula I, surprisingly, do not appear to be related to the counterion selected.

Figure 1B:
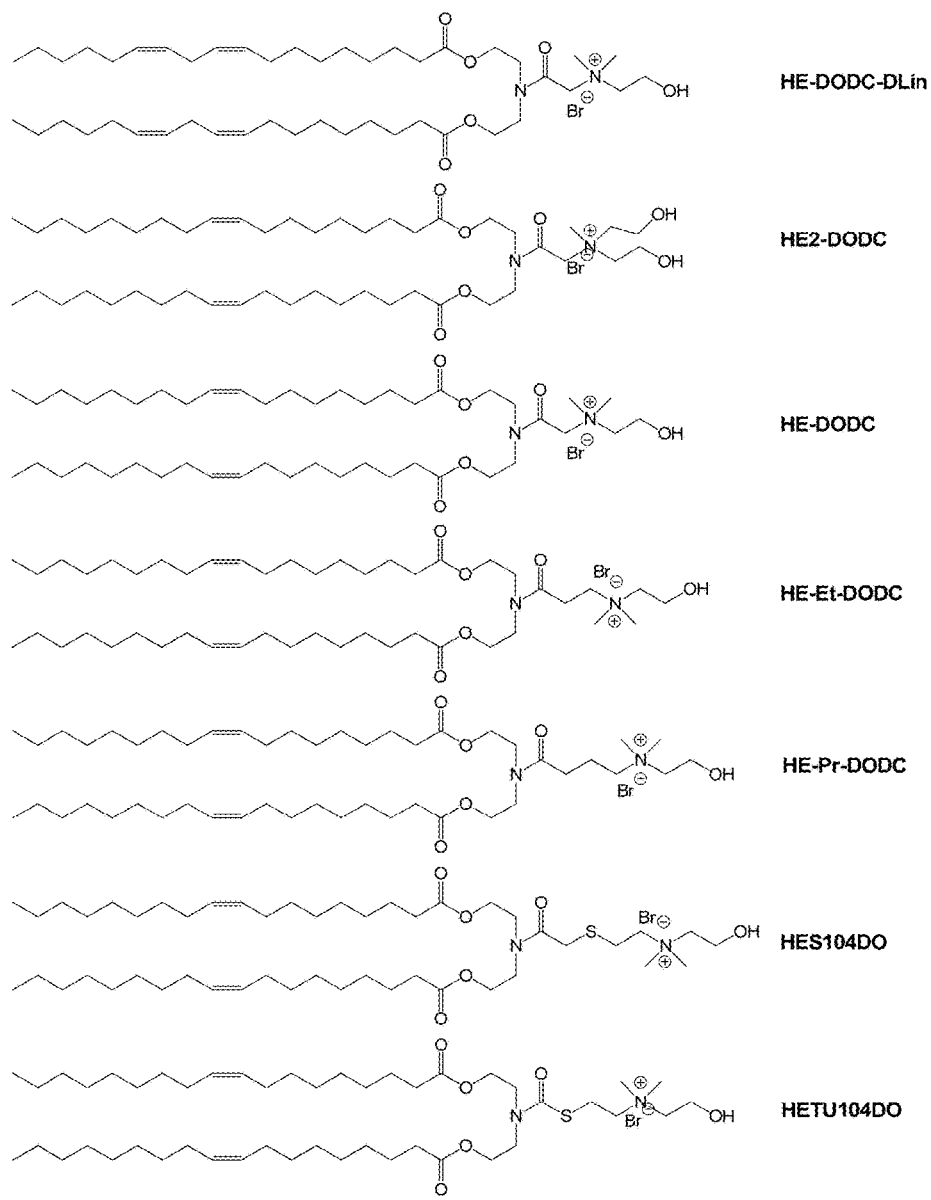

Exemplary compounds of formula I include the compounds shown in FIG. 1.

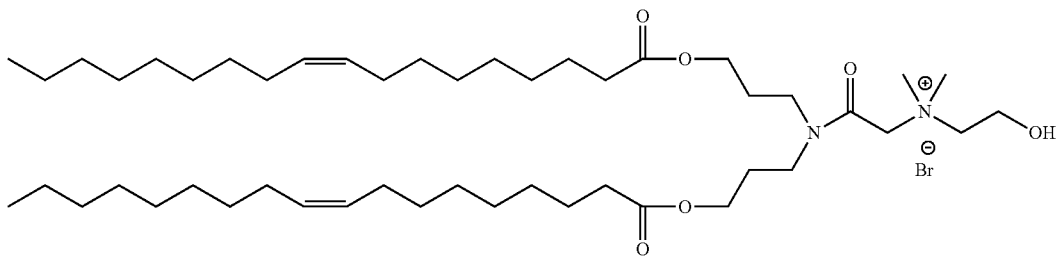 [SMILES: CCCCCCCC/C=C\CCCCCCCC(=O)OCCCN(CCCOC(=O)CCCCCCC/C=C\CCCCCCCC)C(=O)C[N+](C)(C)CCO ; [Br-]]

Such compositions may also include an aqueous medium. Preferably, such compositions consist essentially of at least one compound of formula I in a charge complex with the siRNA. Such compositions including a compound of formula I and siRNA can further comprise a liquid medium. In one embodiment, the liquid medium is suitable for injection into a living organism. Liquid mediums within the scope of any of the described embodiments of the description herein can be aqueous, that is, be comprises entirely of an aqueous solvent, and to include salts, buffers, and/or other pharmaceutical excipients. In another embodiment, the liquid medium may consist of an aqueous solvent in combination with another liquid solvent such as, for example, an organic solvent. Liquid mediums within the scope of any of the described embodiments of the description herein can also include at least one organic solvent. Organic solvents are known in the art per se and include $C_1$ to $C_4$ alcohols, dimethyl sulfoxide ("DMSO"), and the like. Those liquid mediums that include a mixture of water and at least one organic solvent are also within the scope of any of the embodiments of the description herein.

Within the scope of the description herein are compositions that comprise at least one compound of formula I and a liposome. Some embodiments can include mixtures of compounds of formula I and a liposome. Other embodiments can include a liposome and one or more compounds of formula I in addition to cationic lipids that are not within the scope of formula I.

Within the scope of the description herein is a compound for facilitating drug delivery to a target cell, consisting of the structure (targeting molecule)$_m$-linker-(targeting molecule)$_n$, wherein the targeting molecule is a retinoid or a fat soluble vitamin having a specific receptor or activation/binding site on the target cell; and wherein m and n are independently 0, 1, 2, or 3; and wherein the linker comprises a bond, a PEG or PEG-like molecule, and is designated "Formula A".

The description herein also includes a compound for facilitating drug delivery to a target cell, consisting of the structure (lipid)$_m$-linker-(targeting molecule)$_n$, wherein the targeting molecule is a retinoid or a fat soluble vitamin having a specific receptor on the target cell; wherein m and n are independently 0, 1, 2, or 3; and wherein the linker comprises a bond, a PEG or PEG-like molecule and is designated "Formula B".

It has heretofore been discovered that the compounds of Formula A or Formula B impart properties to the formulations of the description herein not previously seen. Formulations including the compounds of Formula A or Formula B result in superior reduction in gene expression, as compared to formulations that do not include these compounds. Particularly surprising is the ability of formulations of the description herein that include compounds of Formula A to reduce the expression of HSP47.

In certain preferred embodiments, the retinoid is selected from the group consisting of vitamin A, retinoic acid, tretinoin, adapalene, 4-HPR, retinyl palmitate, retinal, saturated retinoic acid, and saturated, demethylated retinoic acid.

Preferred embodiments include compounds where the linker is selected from a bond, bis-amido-PEG, tris-amido-PEG, tetra-amido-PEG, Lys-bis-amido-PEG Lys, Lys-tris-amido-PEG-Lys, Lys-tetra-amido-PEG-Lys, Lys-PEG-Lys, PEG2000, PEG1250, PEG1000, PEG750, PEG550, PEG-Glu, Glu, C6, Gly3, and GluNH. In other embodiments, the PEG is mono disperse.

Another embodiment provides a compound where Formula A is selected from retinoid-PEG-retinoid, (retinoid)$_2$-PEG-(retinoid)$_2$, VA-PEG2000-VA, (retinoid)$_2$-bis-amido-PEG-(retinoid)$_2$, and (retinoid)$_2$-Lys-bis-amido-PEG-Lys-(retinoid)$_2$.

In another preferred embodiment, the compound is the formula

Figure 2B:
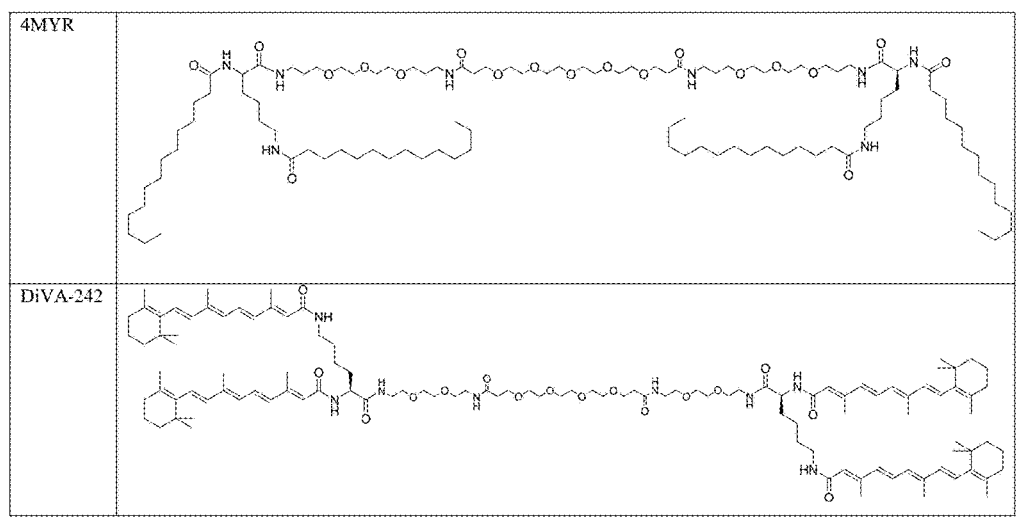

Other embodiments of the description herein include the structures shown in FIGS. 2A and 2B.

Compositions of the description herein that include at least one compound of formula I and a liposome may further comprise one or more retinoid conjugates. In preferred embodiments of the description herein, the retinoid conjugate will be present at a concentration of about 0.3 to about 30 weight percent, based on the total weight of the composition or formulation, which is equivalent to about 0.1 to about 10 mol %, which is equivalent to a molar ratio of about 0.1 to about 10. Preferably, the retinoid conjugate is a retinoid-linker-lipid molecule or a retinoid-linker-retinoid molecule.

The concentration of cationic lipids in compositions of the description herein, including those cationic lipids of formula I, can be from 1 to about 80 weight percent, based on the total weight of the lipid composition. More preferably, the concentration is from 1 to about 75 weight percent. Even more preferably, the concentration is from about 30 to about 75 weight percent. A concentration of from about 30 to about 75 weight percent corresponds to about 30 to 60 mol % and a molar ratio of about 30-60. Most preferred are those compositions having a cationic lipid concentration of about 50 weight percent. In formulations that contain a mixture of an ionizable cationic lipid and a quaternary amine cationic lipid of formula I, the preferred mol % is from 5% to 45 mol %, with even more preferred mixture at approximately 20 mol % of the ionizable cationic lipid and 20 mol % of the quaternary amine cationic lipid for formula I.

Such compositions may also include an aqueous medium. The cationic lipids, including those of formula I, can be encapsulated within the liposome in such embodiments and may be inaccessible to the aqueous medium. Furthermore, the cationic lipids, including those of formula I, can be localized on the outer surface of the liposome and be accessible to the aqueous medium.

Compositions of the description herein that include at least one compound of formula I and a liposome, and optionally a retinoid conjugate such as a compound of formula II, can also include siRNA.

In some embodiments, the siRNA will be encapsulated by the liposome so that the siRNA is inaccessible to the aqueous medium. In other embodiments, the siRNA will not be

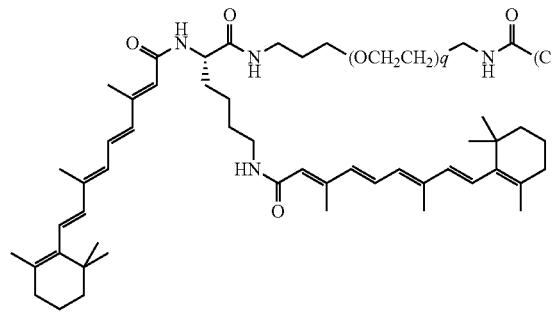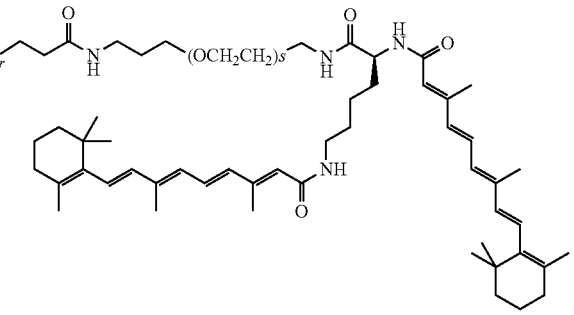

wherein q, r, and s are each independently 1, 2, 3, 4, 5, 6, 7, 8, 9, or 10.

Figure 34A:
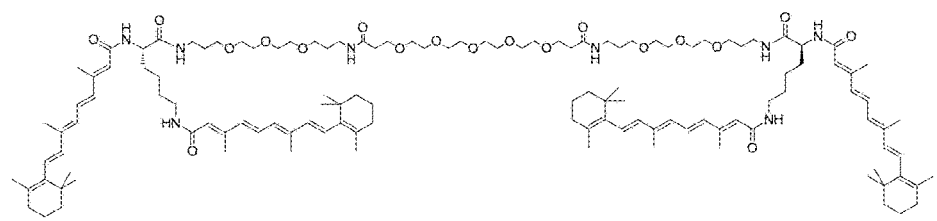
FIG. 34A shows the structure of DiVA.

In other preferred embodiments, the formula of the compound comprises DiVA-PEG-DiVA shown in FIG. 34A.

DiVA-PEG-DiVA includes stereocenters and all enantiomers and diastereomers are considered to be within the scope of the description herein.

encapsulated by the liposome. In such embodiments, the siRNA can be complexed on the outer surface of the liposome. In these embodiments, the siRNA is accessible to the aqueous medium.

A lipid conjugated to a polyethylene glycol molecule (PEG), may be present in the liposome particles. PEG-lipids include 1,2-dimyristoleoyl-sn-glycero-3-phosphoethanolamine-N-PEG (PEG-DMPE)

1,2-dipalmitoyl-sn-glycero-3-phosphoethanolamine-N-PEG (PEG-DPPE), 1,2-distearoyl-sn-glycero-3-phosphoethanolamine-N-PEG (PEG-DSPE), or 1,2-dioleoyl-sn-glycero-3-phosphoethanolamine-N-PEG (PEG-DOPE) and/or PEG-ceramide.

Delivery formulations may consist of a cationic lipid of Formula I in combination with a PEG-lipid. The PEG-lipid may be present at a concentration of 0 to 15 mol %, preferably 1 to 10 mol %, including a concentration selected from 1, 2, 3, 4, 5, 6, 7, 8, 9, and 10 mole %.

The forgoing compositions can also include PEG-conjugated lipids, which are known in the art per se. Suitable PEG-lipids include PEG-phospholipids and PEG-ceramides such as, e.g., PEG2000-DSPE, PEG2000-DPPE, PEG2000-DMPE, PEG2000-DOPE, PEG1000-DSPE, PEG1000-DPPE, PEG1000-DMPE, PEG1000-DOPE, PEG550-DSPE, PEG550-DPPE, PEG-550DMPE, PEG-1000DOPE, PEG-BML, PEG-cholesterol, PEG2000-ceramide, PEG1000-ceramide, PEG750-ceramide, and PEG550-ceramide.

For example, liposomes within the scope of the description herein were prepared using various PEG-lipids, incorporated using co-solubilization methods described herein. These formulations comprised cationic lipid:DOPE:cholesterol:DiVA-PEG-DiVA:PEG-Lipid (50:10:38:5:2 molar ratio) and each formulation was tested in the pHSC in vitro assay described herein using human/rat HSP-47-C siRNA at a concentration of 200 nM. The results are shown in the following table.

| PEG-Lipid | gp46 Gene Knockdown (%) | Std. Dev. |
| --- | --- | --- |
| Untreated | 0 | 5.6 |
| RNAimax Control | 50.0 | 7.9 |
| PEG-BML | 95.5 | 1.7 |
| PEG1000-DMPE | 93.2 | 0.8 |
| PEG1000-DPPE | 92.8 | 1.3 |
| PEG1000-DSPE | 93.5 | 0.8 |
| PEG1000-DOPE | 90.7 | 2.5 |
| PEG2000-Ceramide | 91.8 | 1.0 |
| PEG2000-DMPE | 93.7 | 3.4 |
| PEG2000-DPPE | 91.1 | 1.4 |
| PEG2000-DSPE | 89.4 | 1.7 |

The foregoing compositions of the description herein can include one or more phospholipids such as, for example, 1,2-distearoyl-sn-glycero-3-phosphocholine ("DSPC"), dipalmitoylphosphatidylcholine ("DPPC"), 1,2-dipalmitoyl-sn-glycero-3-phosphoethanolamine ("DPPE"), and 1,2-dioleoyl-sn-glycero-3-phosphoethanolamine ("DOPE"). Preferably, the helper lipid is DOPE.

In addition to the cationic lipid of Formula I, other lipids may be useful. These include ionizable cationic lipids, including S104 consisting of the following formula.

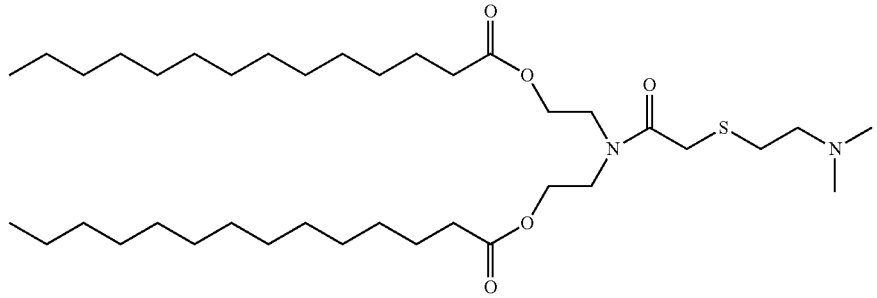

S104

Delivery formulations may consist of a cationic lipid of Formula I in combination with an ionizable cationic lipid. An ionizable cationic lipid may include, e.g., S104. The ionizable cationic lipid may be present at a concentration of 0 to 45 mol %, including a concentration selected from 5, 10, 15, 20, 25, 30, 35 40, and 45 mol %.

Also within the scope of the description herein are pharmaceutical formulations that include any of the aforementioned compositions in addition to a pharmaceutically acceptable carrier or diluent. Pharmaceutical formulations of the description herein include at least one therapeutic agent. Preferably, the therapeutic agent is an siRNA. It is envisioned that any siRNA molecule can be used within the scope of the description herein.

In preferred formulations of the description herein including siRNA, the siRNA is encapsulated by the liposome. In other embodiments, the siRNA can be outside of the liposome. In those embodiments, the siRNA can be complexed to the outside of the liposome.

A useful range of cationic lipid:siRNA (lipid nitrogen to siRNA phosphate ratio, "N:P") is 0.2 to 5.0. Particularly preferred range of N:P is 1.5 to 2.5 for compositions and formulations of the description herein.

Preferred formulations of the description herein include those comprising HEDC:S104:DOPE:cholesterol:PEG-DMPE:DiVA-PEG-DiVA (20:20:30:25:5:2 molar ratio). Even more preferred embodiments include those HEDC:S104:DOPE:cholesterol:PEG-DMPE:DiVA-PEG-DiVA formulations wherein the DiVA-PEG-DiVA is co-solubilized.

Other preferred formulations of the description herein include those comprising HE-DODC:S104:DOPE:cholesterol:PEG-DMPE:DiVA-PEG-DiVA (20:20:30:25:5:2 molar ratio). Even more preferred embodiments include those HE-DODC:S104:DOPE:cholesterol:PEG-DMPE:DiVA-PEG-DiVA formulations wherein the DiVA-PEG-DiVA is co-solubilized.

Other preferred formulations of the description herein include those comprising DC-6-14:DOPE:cholesterol:DiVA-PEG-DiVA (40:30:30:5, molar ratios). In even more preferred embodiments, those formulations comprising DC-6-14: DOPE: cholesterol: DiVA-PEG-DiVA include DiVA-PEG-DiVA that is co-solubilized.

In certain preferred embodiments, the retinoid is 0.1 mol % to 20 mol % of the lipid molecules.

Non-limiting examples of non-cationic lipids include phospholipids such as lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidic acid, cerebrosides, dicetylphosphate, DSPC, dioleoylphosphatidylcholine (DOPC), DPPC, dioleoylphosphatidylglycerol (DOPG), dipalmitoylphosphatidylglycerol (DPPG), DOPE, palmitoyloleoyl-phosphatidylcholine (POPC), palmitoyloleoyl-phosphatidylethanolamine (POPE), palmitoyloleoyl-phosphatidylglycerol (POPG), dioleoylphosphatidylethanolamine 4-(N-maleimidomethyl)-cyclohexane-1-carboxylate (DOPE-mal), DPPE, dimyristoyl-phosphatidylethanolamine (DMPE), distearoyl-phosphatidylethanolamine (DSPE), monomethyl-phosphatidylethanolamine, dimethyl-phosphatidylethanolamine, dielaidoyl-phosphatidylethanolamine (DEPE), stearoyloleoyl-phosphatidylethanolamine (SOPE), lysophosphatidylcholine, dilinoleoylphosphatidylcholine, and mixtures thereof. Other diacylphosphatidylcholine and diacylphosphatidylethanolamine phospholipids can also be used. The acyl structure in these lipids is preferably an acyl derived from fatty acids having $C_{10}$-$C_{24}$ carbon chains, e.g., lauroyl, myristoyl, palmitoyl, stearoyl, or oleoyl.

In certain embodiments, the amount of phospholipid present in particles comprises from about 0 mol % to about 55 mol %, more specifically at a concentration selected from the 5, 10, 15, 20, 25, 30, 35, 40, 45, 50, and 55 mol %. As a non-limiting example, the phospholipid is DOPE.

Additional examples of non-cationic lipids include sterols such as cholesterol and derivatives thereof such as cholestanol, cholestanone, cholestenone, coprostanol, cholesteryl-2'-hydroxyethyl ether, cholesteryl-4'-hydroxybutyl ether, and mixtures thereof.

In certain embodiments, the cholesterol or cholesterol derivative present in particles comprises from about 0 mol % to about 55 mol %, more specifically at a concentration selected from the 5, 10, 15, 20, 25, 30, 35, 40, 45, 50, and 55 mol %. As a non-limiting example, cholesterol is present in the lipid particles.

In certain other embodiments, the cholesterol present in lipid particles containing a mixture of phospholipid and cholesterol comprises from about 30 mol % to about 40 mol %, from about 30 mol % to about 35 mol %, or from about 35 mol % to about 40 mol % of the total lipid present in the particle. As a non-limiting example, a lipid particle comprising a mixture of phospholipid and cholesterol may comprise cholesterol at about 34 mol % of the total lipid present in the particle.

In further embodiments, the cholesterol present in lipid particles containing a mixture of phospholipid and cholesterol comprises from about 10 mol % to about 30 mol %, from about 15 mol % to about 25 mol %, or from about 17 mol % to about 23 mol % of the total lipid present in the particle. As a non-limiting example, a lipid particle comprising a mixture of phospholipid and cholesterol may comprise cholesterol at about 20 mol % of the total lipid present in the particle.

The retinoid or retinoid conjugate useful for delivery of nucleic acid is in a state in which it is dissolved in or mixed with a medium that can dissolve or retain it.

The amount of retinoid and/or retinoid conjugate bonded to or included in the drug carrier of the description herein may be 0.01 mol % to 20 mol % as a ratio by weight relative to the drug carrier components, preferably 0.2 mol % to 10 mol %, and more preferably 0.5% to 5 mol %, including a concentration selected from the values 0.5, 1.0, 1.5, 2.0. 2.5, 3.0, 3.5, 4.0, 4.5, and 5.0 mol %.

In certain embodiments, the description herein provides for a liposome to be produced via mixing in a chamber. This includes a process that provides an aqueous solution comprising a nucleic acid such as an interfering RNA in a first reservoir, providing an organic lipid solution in a second reservoir, and mixing the aqueous solution with the organic lipid solution such that the organic lipid solution mixes with the aqueous solution so as to produce a liposome encapsulating the nucleic acid (e.g., siRNA) in a gradient of organic solvent concentration.

The liposome formed using the mixing method typically have a size of from about 40 nm to about 250 nm, from about 50 nm to about 150 nm, from about 60 nm to about 150 nm. The particles thus formed do not aggregate and are optionally sized to achieve a uniform particle size.

Also within the scope of the description herein are methods of delivering a therapeutic agent to a patient. These methods comprise providing a pharmaceutical formulation including any of the foregoing compositions and a pharmaceutically acceptable carrier or diluent, and administering the pharmaceutical formulation to the patient.

The description herein includes a drug carrier or therapeutic formulation preparation kit containing one or more containers, one or more drug carrier constituents, a retinoid and/or a retinoid conjugate, and/or a drug, and an essential component for the drug carrier or the therapeutic formulation, provided in the form of the kit. The kit contains, in addition to those components described above, a preparation method or an administration method for the drug carrier and the therapeutic formulation. Furthermore, the kit of the description herein may contain all components for completing the drug carrier or the therapeutic formulation but need not necessarily contain all of the components. The kit of the description herein therefore need not contain a reagent or a solvent that is normally available at a place of medical treatment, an experimental facility, such as, for example, sterile water, saline, or a glucose solution.

The description herein further relates to a method for treating a stellate cell-related disorder, the method including administering an effective amount of the therapeutic formulation to a subject in need thereof. The effective amount referred to here is an amount that suppresses onset of the target disorder, reduces symptoms thereof, or prevents progression thereof, and is preferably an amount that prevents onset of the target disorder or cures the target disorder. It is also preferably an amount that does not cause an adverse effect that exceeds the benefit from administration. Such an amount may be determined as appropriate by an in vitro test using cultured cells, or by a test in a model animal such as a mouse, a rat, a dog, or a pig, and such test methods are well known to a person skilled in the art.

In the method of the description herein, the term "subject" means any living individual, preferably an animal, more preferably a mammal, and yet more preferably a human individual. In the description herein, the subject may be healthy or affected with some disorder, and in the case of treatment of a disorder being intended, the subject typically means a subject affected with the disorder or having a risk of being affected.

Furthermore, the term "treatment" includes all types of medically acceptable prophylactic and/or therapeutic intervention for the purpose of the cure, temporary remission, prevention, of a disorder. For example, when the disorder is hepatic fibrosis, the term "treatment" includes medically acceptable intervention for various purposes including delaying or halting the progression of fibrosis, regression or disappearance of lesions, prevention of the onset of fibrosis, or prevention of recurrence.

The description herein also relates to a method for delivering a drug to stellate cells using the drug carrier. This method includes, but is not limited to, a step of supporting a substance to be delivered on the drug carrier, and a step of administering or adding the drug carrier carrying the substance to be delivered to a stellate cell-containing living body or medium, such as, for example, a culture medium. These steps may be achieved as appropriate in accordance with any known method, the method described herein. This delivery method may be combined with another delivery method, for example, another delivery method in which an organ where stellate cells are present is the target.

Delivery systems may include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

The drug carrier of the present description may be in any form as long as a desired material or body can be transported to target stellate cells, and examples of the form include, but are not limited to, polymer micelle, liposome, emulsion, microsphere, and nanosphere. Furthermore, the drug carrier of the present description may include in its interior the substance that is to be transported, be attached to the exterior of the substance that is to be transported, or be mixed with the substance that is to be transported as long as the retinoid and/or retinoid conjugate included therein is at least partially exposed on the exterior of the preparation before it reaches the stellate cells at the latest.

The drug carrier of the present description specifically targets stellate cells and enables a desired effect such as, for example, inhibition or prevention of fibrosis to be exhibited with the maximum effect and minimum side effects by efficiently transporting to stellate cells a desired material or body such as, for example, a drug for controlling the activity or growth of stellate cells. The material or body that the present drug carrier delivers is not particularly limited, but it preferably has a size that enables physical movement in a living body from an administration site to the liver, pancreas, etc., where stellate cells are present. The drug carrier of the present description therefore can transport not only a material such as an atom, a molecule, a compound, a protein, or a nucleic acid but also a body such as a vector, a virus particle, a cell, a drug release system constituted from one or more elements, or a micromachine. The material or body preferably has the property of exerting some effect on stellate cells, and examples thereof include one that labels stellate cells and one that controls the activity or growth of stellate cells.

Therefore, in one embodiment of the present description, it is a drug for controlling the activity or growth of stellate cells that the drug carrier delivers. This may be any drug that directly or indirectly inhibits the physicochemical actions of stellate cells involved in the promotion of fibrosis, and examples thereof include, but are not limited to, TGFβ activity inhibitors such as a truncated TGFβ type II receptor and a soluble TGFβ type II receptor, growth factor preparations such as HGF and expression vectors therefor, MMP production promoters such as an MMP gene-containing adenovirus vector, TIMP production inhibitors such as an antisense TIMP nucleic acid, a PPARγ ligand, cell activation inhibitors and/or cell growth inhibitors such as an angiotensin activity inhibitor, a PDGF activity inhibitor, and a sodium channel inhibitor, and also apoptosis inducers such as compound 861 and gliotoxin, adiponectin, and a compound having Rho kinase inhibitory activity such as (+)-trans-4-(1-aminoethyl)-1-(4-pyridylcarbamoyl)cyclohexane. Furthermore, the 'drug for controlling the activity or growth of stellate cells' in the present description may be any drug that directly or indirectly promotes the physicochemical actions of stellate cells directly or indirectly involved in the inhibition of fibrosis, and examples thereof include, but are not limited to, a drug for promoting a collagen degradation system, e.g., MMP production promoters such as an MMP expression vector, HGF, and drugs having HGF-like activity such as HGF analogues and expression vectors therefor.

Other examples of the drug for controlling the activity or growth of stellate cells in the present description include a drug for controlling the metabolism of an extracellular matrix such as collagen, for example, a substance having an effect in inhibiting the expression of a target molecule, such as siRNA, ribozyme, and antisense nucleic acid (including RNA, DNA, PNA, and a composite thereof), a substance having a dominant negative effect, and vectors expressing same, that target, for example, an extracellular matrix constituent molecule produced by stellate cells or target one or more molecules that have the function of producing or secreting the extracellular matrix constituent molecule.

The present description also relates to a therapeutic formulation for treating a stellate cell-related disorder, the therapeutic formulation containing the drug carrier and the drug for controlling the activity or growth of stellate cells, and relates to the use of the drug carrier in the production of a pharmaceutical composition for treating a stellate cell-related disorder. The stellate cell-related disorder referred to here means a disorder in which stellate cells are directly or indirectly involved in the process of the disorder, that is, the onset, exacerbation, improvement, remission, cure, etc. of the disorder, and examples thereof include hepatic disorders such as hepatitis, in particular chronic hepatitis, hepatic fibrosis, hepatic cirrhosis, and liver cancer, and pancreatic disorders such as pancreatitis, in particular chronic pancreatitis, pancreatic fibrosis, and pancreatic cancer.

In the therapeutic formulation of the present description, the drug carrier may include a drug in its interior, be attached to the exterior of a drug-containing substance, or be mixed with a drug as long as the retinoid and/or retinoid-conjugate included in the drug carrier is at least partially exposed on the exterior of the preparation before it reaches the stellate cells at the latest. Therefore, depending on the route of administration or manner in which the drug is released, the therapeutic formulation may be covered with an appropriate material, such as, for example, an enteric coating or a material that disintegrates over time, or may be incorporated into an appropriate drug release system.

The present description therefore includes a drug carrier or therapeutic formulation preparation kit containing one or more containers containing one or more of a drug carrier constituent, a retinoid and/or a retinoid conjugate, and/or a drug, and also includes an essential component for the drug carrier or the therapeutic formulation provided in the form of such a kit. The kit of the present description may contain, in addition to those described above, a description, etc. in which a preparation method or an administration method for the drug carrier and the therapeutic formulation of the present description is described. Furthermore, the kit of the present description may contain all components for completing the drug carrier or the therapeutic formulation of the present description but need not necessarily contain all of the components. The kit of the present description therefore need not contain a reagent or a solvent that is normally available at a place of medical treatment, an experimental facility, etc., such as, for example, sterile water, saline, or a glucose solution.

The present description further relates to a method for treating a stellate cell-related disorder, the method including administering an effective amount of the therapeutic formulation to a subject in need thereof. The effective amount referred to here is an amount that suppresses onset of the target disorder, reduces symptoms thereof, or prevents progression thereof, and is preferably an amount that prevents onset of the target disorder or cures the target disorder. It is also preferably an amount that does not cause an adverse effect that exceeds the benefit from administration. Such an amount may be determined as appropriate by an in vitro test using cultured cells, etc. or by a test in a model animal such as a mouse, a rat, a dog, or a pig, and such test methods are well known to a person skilled in the art.

In the method of the present description, the term 'subject' means any living individual, preferably an animal, more preferably a mammal, and yet more preferably a human individual. In the present description, the subject may be healthy or affected with some disorder, and in the case of treatment of a disorder being intended, the subject typically means a subject affected with the disorder or having a risk of being affected.

Furthermore, the term 'treatment' includes all types of medically acceptable prophylactic and/or therapeutic intervention for the purpose of the cure, temporary remission, prevention, etc. of a disorder. For example, when the disorder is hepatic fibrosis, the term 'treatment' includes medically acceptable intervention for various purposes including delaying or halting the progression of fibrosis, regression or disappearance of lesions, prevention of the onset of fibrosis, or prevention of recurrence.

The present description also relates to a method for delivering a drug to stellate cells using the drug carrier. This method includes, but is not limited to, a step of supporting a substance to be delivered on the drug carrier, and a step of administering or adding the drug carrier carrying the substance to be delivered to a stellate cell-containing living body or medium, such as, for example, a culture medium. These steps may be achieved as appropriate in accordance with any known method, the method described in the present specification, etc. This delivery method may be combined with another delivery method, for example, another delivery method in which an organ where stellate cells are present is the target, etc.

Nucleic acid molecules may be adapted for use to prevent or treat fibroses (e.g., liver, kidney, peritoneal, and pulmonary) diseases, traits, conditions and/or disorders, and/or any other trait, disease, disorder or condition that is related to or will respond to the levels of hsp47 in a cell or tissue, alone or in combination with other therapies. A nucleic acid molecule may include a delivery vehicle, including liposomes, for administration to a subject, carriers and diluents and their salts, and/or can be present in pharmaceutically acceptable formulations.

The nucleic acid molecules of the description may include sequences shown in Table 3, infra. Examples of such nucleic acid molecules consist essentially of sequences provided in Table 3.

The nucleic acid molecules may be administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the description can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles may include a nucleic acid molecules disclosed herein and can be produced by any suitable means, such as with a nebulizer (see e.g., U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers include the active ingredient in a liquid carrier in an amount of up to 40% w/w preferably less than 20% w/w of the formulation. The carrier is typically water or a dilute aqueous alcoholic solution, preferably made isotonic with body fluids by the addition of, e.g., sodium chloride or other suitable salts. Optional additives include preservatives if the formulation is not prepared sterile, e.g., methyl hydroxybenzoate, anti-oxidants, flavorings, volatile oils, buffering agents and emulsifiers and other formulation surfactants. The aerosols of solid particles including the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration. One illustrative type of solid particulate aerosol generator is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically includes from 0.1 to 100 w/w of the formulation. A second type of illustrative aerosol generator includes a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume to produce a fine particle spray containing the active ingredient. Suitable propellants include certain chlorofluorocarbon compounds, e.g., dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, e.g., US20040037780, U.S. Pat. No. 6,592,904, U.S. Pat. No. 6,582,728, and U.S. Pat. No. 6,565,885. WO08132723 relates to aerosol delivery of oligonucleotides in general, and of siRNA in particular, to the respiratory system.

Nucleic acid molecules may be administered to the central nervous system (CNS) or peripheral nervous system (PNS). Experiments have demonstrated the efficient in vivo uptake of nucleic acids by neurons. See e.g., Sommer et al., 1998, Antisense Nuc. Acid Drug Dev., 8:75; Epa et al., 2000, Antisense Nuc. Acid Drug Dev., 10:469; Broaddus et al., 1998, J. Neurosurg., 88:734; Karle et al., 1997, Eur. J. Pharmocol., 340:153; Bannai et al., 1998, Brain Research, 784:304; Rajakumar et al., 1997, Synapse, 26:199; Wu-pong et al., 1999, BioPharm, 12:32; Bannai et al., 1998, Brain Res. Protoc., 3:83; and Simantov et al., 1996, Neuroscience, 74:39. Nucleic acid molecules are therefore amenable to delivery to and uptake by cells in the CNS and/or PNS.

Delivery of nucleic acid molecules to the CNS is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example through the use of conjugates and biodegradable polymers. Furthermore, gene therapy approaches, e.g., as described in Kaplitt et al., U.S. Pat. No. 6,180,613 and Davidson, WO 04/013280, can be used to express nucleic acid molecules in the CNS.

Nucleic acid molecules may be formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, AAPA PharmSci, 3, 1-11; Furgeson et al., 2003, Bioconjugate Chem., 14, 840-847; Kunath et al., 2002, Pharm Res 19:810-17; Choi et al., 2001, Bull. Korean Chem. Soc., 22:46-52; Bettinger et al., 1999, Bioconjugate Chem., 10:558-561; Peterson et al., 2002, Bioconjugate Chem. 13:845-54; Erbacher et al., 1999, J Gene Med 1:1-18; Godbey et al., 1999., PNAS, 96:5177-81; Godbey et al., 1999, J Controlled Release, 60:149-60; Diebold et al., 1999, J Biol Chem, 274:19087-94; Thomas et al., 2002, PNAS, 99, 14640-45; and Sagara, U.S. Pat. No. 6,586,524).

Nucleic acid molecules may include a bioconjugate, for example a nucleic acid conjugate as described in Vargeese et al., U.S. Ser. No. 10/427,160; U.S. Pat. No. 6,528,631; U.S. Pat. No. 6,335,434; U.S. Pat. No. 6,235,886; U.S. Pat. No. 6,153,737; U.S. Pat. No. 5,214,136; U.S. Pat. No. 5,138,045.

Compositions, methods and kits disclosed herein may include an expression vector that includes a nucleic acid sequence encoding at least one nucleic acid molecule of the description in a manner that allows expression of the nucleic acid molecule. Methods of introducing nucleic acid molecules or one or more vectors capable of expressing the strands of dsRNA into the environment of the cell will depend on the type of cell and the make up of its environment. The nucleic acid molecule or the vector construct may be directly introduced into the cell (i.e., intracellularly); or introduced extracellularly into a cavity, interstitial space, into the circulation of an organism, introduced orally, or may be introduced by bathing an organism or a cell in a solution containing dsRNA. The cell is preferably a mammalian cell; more preferably a human cell. The nucleic acid molecule of the expression vector can include a sense region and an antisense region. The antisense region can include a sequence complementary to a RNA or DNA sequence encoding hsp47 and the sense region can include a sequence complementary to the antisense region. The nucleic acid molecule can include two distinct strands having complementary sense and antisense regions. The nucleic acid molecule can include a single-strand having complementary sense and antisense regions.

Nucleic acid molecules that interact with target RNA molecules and down-regulate gene encoding target RNA molecules (e.g., target RNA molecules referred to by Genbank Accession numbers herein) may be expressed from transcription units inserted into DNA or RNA vectors. Recombinant vectors can be DNA plasmids or viral vectors. Nucleic acid molecule expressing viral vectors can be constructed based on, but not limited to, adeno-associated virus, retrovirus, adenovirus, or alphavirus. The recombinant vectors capable of expressing the nucleic acid molecules can be delivered as described herein, and persist in target cells. Alternatively, viral vectors can be used that provide for transient expression of nucleic acid molecules. Such vectors can be repeatedly administered as necessary. Once expressed, the nucleic acid molecules bind and down-regulate gene function or expression via RNA interference (RNAi). Delivery of nucleic acid molecule expressing vectors can be systemic, such as by intravenous or intramuscular administration, by administration to target cells explanted from a subject followed by reintroduction into the subject, or by any other means that would allow for introduction into the desired target cell.

Expression vectors may include a nucleic acid sequence encoding at least one nucleic acid molecule disclosed herein, in a manner which allows expression of the nucleic acid molecule. For example, the vector may contain sequence(s) encoding both strands of a nucleic acid molecule that include a duplex. The vector can also contain sequence(s) encoding a single nucleic acid molecule that is self-complementary and thus forms a nucleic acid molecule. Non-limiting examples of such expression vectors are described in Paul et al., 2002, Nature Biotech 19, 505; Miyagishi et al., 2002, Nature Biotech 19, 497; Lee et al., 2002, Nature Biotech 19, 500; and Novina et al., 2002, Nature Med: 10.1038/nm725. Expression vectors may also be included in a mammalian (e.g., human) cell.

An expression vector may include a nucleic acid sequence encoding two or more nucleic acid molecules, which can be the same or different. Expression vectors may include a sequence for a nucleic acid molecule complementary to a nucleic acid molecule referred to by a Genbank Accession number NM_001235, for example those shown in Table 2.

An expression vector may encode one or both strands of a nucleic acid duplex, or a single self-complementary strand that self hybridizes into a nucleic acid duplex. The nucleic acid sequences encoding nucleic acid molecules can be operably linked in a manner that allows expression of the nucleic acid molecule (see for example Paul et al., 2002, Nature Biotech, 19:505; Miyagishi and Taira, 2002, Nature Biotech 19:497; Lee et al., 2002, Nature Biotech 19:500; and Novina et al., 2002, Nature Med, 10.1038/nm725).

An expression vector may include one or more of the following: a) a transcription initiation region (e.g., eukaryotic pol I, II or III initiation region); b) a transcription termination region (e.g., eukaryotic pol I, II or III termination region); c) an intron and d) a nucleic acid sequence encoding at least one of the nucleic acid molecules, wherein said sequence is operably linked to the initiation region and the termination region in a manner that allows expression and/or delivery of the nucleic acid molecule. The vector can optionally include an open reading frame (ORF) for a protein operably linked on the 5' side or the 3'-side of the sequence encoding the nucleic acid molecule; and/or an intron (intervening sequences).

Transcription of the nucleic acid molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy et al., 1990, PNAS, 87:6743-47; Gao et al., 1993, Nucleic Acids Res 21:2867-72; Lieber et al., 1993, Methods Enzymol., 217:47-66; Zhou et al., 1990, Mol. Cell. Biol. 10:4529-37). Several investigators have demonstrated that nucleic acid molecules expressed from such promoters can function in mammalian cells (e.g. Kashani-Sabet et al., 1992, Antisense Res. Dev., 2:3-15; Ojwang et al., 1992, PNAS 89:10802-06; Chen et al., 1992, Nucleic Acids Res., 20:4581-89; Yu et al., 1993, PNAS, 90:6340-44; L'Huillier et al., 1992, EMBO J., 11:4411-18; Lisziewicz et al., 1993, PNAS 90: 8000-04; Thompson et al., 1995, Nucleic Acids Res., 23:2259; Sullenger et al., 1993, Science, 262:1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res. 22:2830; Noonberg et al., U.S. Pat. No. 5,624,803; Good et al., 1997, Gene Ther., 4:45; Beigelman et al., WO 96/18736). The above nucleic acid transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors)(see Couture and Stinchcomb, 1996 supra).

Nucleic acid molecule may be expressed within cells from eukaryotic promoters (e.g., Izant and Weintraub, 1985, Science, 229, 345; McGarry and Lindquist, 1986, PNAS 83, 399; Scanlon et al., 1991, PNAS 88:10591-95; Kashani-Sabet et al., 1992, Antisense Res. Dev., 2:3-15; Dropulic et al., 1992, J. Virol., 66:1432-41; Weerasinghe et al., 1991, J. Virol., 65:5531-34; Ojwang et al., 1992, PNAS, 89:10802-06; Chen et al., 1992, Nucleic Acids Res., 20:4581-89; Sarver et al., 1990 Science, 247:1222-25; Thompson et al., 1995, Nucleic Acids Res., 23:2259; Good et al., 1997, Gene Therapy, 4:45). Those skilled in the art realize that any nucleic acid can be expressed in eukaryotic cells from the appropriate DNA/RNA vector. The activity of such nucleic acids can be augmented by their release from the primary transcript by a enzymatic nucleic acid (WO 93/23569, WO 94/02595; Ohkawa et al., 1992, Nucleic Acids Symp. Ser., 27:15-6; Taira et al., 1991, Nucleic Acids Res., 19:5125-30; Ventura et al., 1993, Nucleic Acids Res., 21:3249-55; Chowrira et al., 1994, J. Biol. Chem., 269:25856).

A viral construct packaged into a viral particle would accomplish both efficient introduction of an expression construct into the cell and transcription of dsRNA construct encoded by the expression construct.

Methods for oral introduction include direct mixing of RNA with food of the organism, as well as engineered approaches in which a species that is used as food is engineered to express RNA, then fed to the organism to be affected. Physical methods may be employed to introduce a nucleic acid molecule solution into the cell. Physical methods of introducing nucleic acids include injection of a solution containing the nucleic acid molecule, bombardment by particles covered by the nucleic acid molecule, soaking the cell or organism in a solution of the RNA, or electroporation of cell membranes in the presence of the nucleic acid molecule.

Other methods known in the art for introducing nucleic acids to cells may be used, such as lipid-mediated carrier transport, chemical mediated transport, such as calcium phosphate, and the like. Thus the nucleic acid molecules may be introduced along with components that perform one or more of the following activities: enhance RNA uptake by the cell, promote annealing of the duplex strands, stabilize the annealed strands, or other-wise increase inhibition of the target gene.

Dosages

The useful dosage to be administered and the particular mode of administration will vary depending upon such factors as the cell type, or for in vivo use, the age, weight and the particular animal and region thereof to be treated, the particular nucleic acid and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved.

When lipids are used to deliver the nucleic acid, the amount of lipid compound that is administered can vary and generally depends upon the amount of nucleic acid being administered. For example, the weight ratio of lipid compound to nucleic acid is preferably from about 1:1 to about 30:1, with a weight ratio of about 5:1 to about 15:1 being more preferred.

A suitable dosage unit of nucleic acid molecules may be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day.

Suitable amounts of nucleic acid molecules may be introduced and these amounts can be empirically determined using standard methods. Effective concentrations of individual nucleic acid molecule species in the environment of a cell may be about 1 femtomolar, about 50 femtomolar, 100 femtomolar, 1 picomolar, 1.5 picomolar, 2.5 picomolar, 5 picomolar, 10 picomolar, 25 picomolar, 50 picomolar, 100 picomolar, 500 picomolar, 1 nanomolar, 2.5 nanomolar, 5 nanomolar, 10 nanomolar, 25 nanomolar, 50 nanomolar, 100 nanomolar, 500 nanomolar, 1 micromolar, 2.5 micromolar, 5 micromolar, 10 micromolar, 100 micromolar or more.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

Pharmaceutical compositions that include the nucleic acid molecule disclosed herein may be administered once daily, qid, tid, bid, QD, or at any interval and for any duration that is medically appropriate. However, the therapeutic agent may also be dosed in dosage units containing two, three, four, five, six or more sub-doses administered at appropriate intervals throughout the day. In that case, the nucleic acid molecules contained in each sub-dose may be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. The dosage unit may contain a corresponding multiple of the daily dose. The composition can be compounded in such a way that the sum of the multiple units of a nucleic acid together contain a sufficient dose.

Pharmaceutical Compositions, Kits, and Containers

Also provided are compositions, kits, containers and formulations that include a nucleic acid molecule (e.g., an siNA molecule) as provided herein for reducing expression of hsp47 for administering or distributing the nucleic acid molecule to a patient. A kit may include at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container includes an antibody, binding fragment thereof or specific binding protein for use in evaluating hsp47 protein expression cells and tissues, or for relevant laboratory, prognostic, diagnostic, prophylactic and therapeutic purposes; indications and/or directions for such uses can be included on or with such container, as can reagents and other compositions or tools used for these purposes. Kits may further include associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be a nucleic acid molecule capable of specifically binding hsp47 and/or modulating the function of hsp47.

A kit may further include a second container that includes a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

The units dosage ampoules or multidose containers, in which the nucleic acid molecules are packaged prior to use, may include an hermetically sealed container enclosing an amount of polynucleotide or solution containing a polynucleotide suitable for a pharmaceutically effective dose thereof, or multiples of an effective dose. The polynucleotide is packaged as a sterile formulation, and the hermetically sealed container is designed to preserve sterility of the formulation until use.

The container in which the polynucleotide including a sequence encoding a cellular immune response element or fragment thereof may include a package that is labeled, and the label may bear a notice in the form prescribed by a governmental agency, for example the Food and Drug Administration, which notice is reflective of approval by the agency under Federal law, of the manufacture, use, or sale of the polynucleotide material therein for human administration.

The dosage to be administered depends to a large extent on the condition and size of the subject being treated as well as the frequency of treatment and the route of administration. Regimens for continuing therapy, including dose and frequency may be guided by the initial response and clinical judgment. The parenteral route of injection into the interstitial space of tissues is preferred, although other parenteral routes, such as inhalation of an aerosol formulation, may be required in specific administration, as for example to the mucous membranes of the nose, throat, bronchial tissues or lungs.

As such, provided herein is a pharmaceutical product which may include a polynucleotide including a sequence encoding a cellular immune response element or fragment thereof in solution in a pharmaceutically acceptable injectable carrier and suitable for introduction interstitially into a tissue to cause cells of the tissue to express a cellular immune response element or fragment thereof, a container enclosing the solution, and a notice associated with the container in form prescribed by a governmental agency regulating the manufacture, use, or sale of pharmaceuticals, which notice is reflective of approval by the agency of manufacture, use, or sale of the solution of polynucleotide for human administration.

Indications

The nucleic acid molecules disclosed herein can be used to treat diseases, conditions or disorders associated with hsp47, such as liver fibrosis, cirrhosis, pulmonary fibrosis, kidney fibrosis, peritoneal fibrosis, chronic hepatic damage, and fibrillogenesis and any other disease or conditions that are related to or will respond to the levels of hsp47 in a cell or tissue, alone or in combination with other therapies. As such, compositions, kits and methods disclosed herein may include packaging a nucleic acid molecule disclosed herein that includes a label or package insert. The label may include indications for use of the nucleic acid molecules such as use for treatment or prevention of liver fibrosis, peritoneal fibrosis, kidney fibrosis and pulmonary fibrosis, and any other disease or conditions that are related to or will respond to the levels of hsp47 in a cell or tissue, alone or in combination with other therapies. A label may include an indication for use in reducing expression of hsp47. A "package insert" is used to refer to instructions customarily included in commercial packages of therapeutic products, that contain information about the indications, usage, dosage, administration, contraindications, other therapeutic products to be combined with the packaged product, and/or warnings concerning the use of such therapeutic products, etc.

Those skilled in the art will recognize that other antifibrosis treatments, drugs and therapies known in the art can be readily combined with the nucleic acid molecules herein (e.g., siNA molecules) and are hence contemplated herein.

The methods and compositions provided herein will now be described in greater detail by reference to the following non-limiting examples.

Example 1 Preparation of siRNA for gp46

Among optimal sequences for siRNA recognition in targeting a base sequence of HSP47, which is a common molecular chaperone for collagens (types I to IV), Sequences A and B were prepared in accordance with an siRNA oligo design program by iGENE Therapeutics, Inc. Sequence C was prepared by searching on the Internet using the siRNA Target Finder from Ambion, Inc. and selecting 19 base sequences that would become a target for rat gp46 (human HSP47 homologue, GenBank Accession No. M69246). When carrying out the design, care was taken in starting at 75 to 100 bases downstream from the initiation codon, positioning the first AA dimer, and making sure that the GC content was 30% to 70%. In this example, siRNAs having the sequences below were prepared.

A: GUUCCACCAUAAGAUGGUAGACAAC    SEQ ID NO: 2730
B: CCACAAGUUUUAUAUCCAAUCUAGC    SEQ ID NO: 2731
C: GAAACCUGUAGAGGCCGCA          SEQ ID NO: 2732

Example 2 Inhibition of gp46 Expression by Prepared siRNA

Normal rat kidney cells (NRK cells), which had rat gp46 and were fibroblasts producing collagen, were transfected with 0.1 nM to 50 nM siRNA and cultured for 12 to 48 hours. The amount of expression of gp46 was checked by the western blot method. All of the siRNAs inhibited the expression of gp46 protein remarkably compared with a vehicle. In the experiment below, siRNA Sequence A, which showed the strongest effect, was used. Inhibition by siRNA was concentration dependent; protein expression by gp46 was about 90% inhibited by 50 nM siRNA at 48 hours.

Example 3 Inhibition of Collagen Synthesis by Prepared siRNA

In order to examine the amount of collagen synthesized, $^3$H-proline was added to the culture supernatant of rat fibroblasts (NRK cells) under the above-mentioned conditions (siRNA concentration 50 nM, 48 hours), and after transfection the amount of $^3$H in secreted protein was examined. The amount of collagen synthesized was calculated from the ratio of protein secreted in the supernatant to protein degraded by collagenase when culturing gp46siRNA-transfected fibroblasts in the presence of $^3$H-proline in accordance with Peterkofsky et al., 1971 Biochemistry 10:988-94.

Collagen synthesis ratio=collagenase-sensitive fraction×100(5.4×collagenase-insensitive fraction+collagenase-sensitive fraction)

The collagen synthesis ratio in rat fibroblasts decreased by about 40% compared with a control group.

Example 4 Specific Transfection of Nucleic Acid into HSC

An emulsion (VA-Lip-GFP) was prepared by mixing green fluorescent protein (GFP) expression plasmid and liposome-encapsulated VA formed by mixing 10% vitamin A (VA) and liposome. Cationic liposomes containing O,O'-ditetradecanolyl-N-(α-trimethylammonioacetyl) diethanolamine chloride (DC-6-14) as a cationic lipid, cholesterol, and dioleoylphosphatidylethanolamine at a molar ratio of 4:3:3 were dissolved in a chloroform-methanol mixture (4:1, v:v), and the solvent was removed by evaporation under vacuum. The lipids were mixed with an aqueous 9% sucrose solution and hydrated at 60° C. and homogenized to uniformity. The dispersion was extruded twice through a polyvinylidenedifluroide membrane filter with a 0.22 μm pore size. The dispersion was aliquotted into glass vials and frozen and then lyophilized. The dried liposomes were reconsitituted with distilled water at a concentration of 1 mM DC-6-14 under vortexing before use. Specifically, 25 mg of vitamin A was first dissolved in 87 μL of dimethylsufoxide (DMSO) thus to give a 100 mM stock solution. To prepare VA-coupled liposomes, 200 nmol of VA dissolved in DMSO was mixed with 100 nmole of DC-6-14 by vortexing at room temperature. The VA-siRNA-liposomes were intraportally administered to a rat, hepatic tissue was collected and fixed. The emulsion was prepared by supposing that the amount of plasma for a 200 g rat was about 10 mL, and setting the concentrations of VA and GFP in portal blood at 10 μM. 1 μL of this VA stock solution was mixed with 10 μL of the VA-liposomes and 179 μL of PBS, 10 μg of GFP expression plasmid was further added thereto to give a total of 200 μL, and the mixture was vortexed for three minutes to give VA-Lip-GFP. The abdomen of an SD rat was opened, and the VA-Lip-GFP was slowly injected into a peripheral portal vein. Forty-eight hours after the injection, hepatic tissue was harvested. Since compared with other hepatic cells intermediate filament desmin is specifically expressed in HSC, when fixed hepatic tissue was stained with fluorescent-labeled anti-desmin antibody, and a fluorescence double image with GFP was examined, it was confirmed that GFP was expressed within the HSC. For untreated controls and a group to which the GFP expression plasmid vector alone was administered, expression in rat HSC was not observed, but in a group to which VA-Lip-GFP was administered, expression of GFP was observed specifically in stellate cells.

Example 5 Quantitative Analysis of Nucleic Acid Transfection Rate

In the same manner as in Example 4, except that FITC-labeled gp46siRNA was used instead of the GFP expression plasmid, an emulsion (VA-Lip-gp46siRNA (FITC)) containing VA-encapsulated liposome and FITC-labeled gp46siRNA was prepared. A solution of siRNAgp46 (580 pmole/μl in distilled water) was added to the VA-coupled liposome solution of Example 4 with stirring at room temperature. The ratio of siRNA to DC-6-14 was 1:11.5

(mol/mol) and the siRNA to liposome ratio (wt/wt) was 1:1. Free VA or siRNA was removed by micropartition. Material trapped on the membrane was reconstituted with PBS and intraportally administered to an SD rat (10 µg as the amount of siRNA/200 µL). Forty-eight hours after administration hepatic tissue was harvested, αSMA (smooth muscle actin), which compared with other hepatic cells is expressed specifically in HSC, was stained with anti-αSMA antibody, cell nuclei were stained with DAPI, and a fluorescence image was examined by a confocal laser scanning microscope (LSM). In a group to which VA-Lip-gp46siRNA (FITC) was administered, a large number of cells emitting both green fluorescence due to FITC and red fluorescence were observed, and when a quantitative analysis was carried out by NIH Image (the number of cells was counted by selecting any 10 fields from a X1000 fluorescence microscope photograph), the transfection efficiency was 77.6% (average of 10 fields). On the other hand, in a group to which Lip-gp46siRNA (FITC) containing no VA was administered, the transfection efficiency was a low value of 14.0% and, moreover, transfection into cells other than stellate cells was observed at 3.0%. It has been found from the results above that the transfection efficiency into stellate cells is increased remarkably by including VA.

Example 6 Inhibition of Expression of gp46 by VA-Lip-gp46siRNA

With regard to another section of the tissue harvested in Example 5, gp46 was stained with fluorescent-labeled anti-HSP47 antibody and cell nuclei were stained with DAPI, and a fluorescence image was examined by a LSM. It was observed that in a group to which VA-Lip-gp46siRNA was administered, expression of gp46 was markedly reduced compared with a control group to which was administered VA-Lip-random siRNA containing random siRNA, which was not specific to gp46. The expression inhibition rate relative to an average of six fields of the control group was 75%, which was extremely high, when the number of gp46-negative cells was examined by selecting any ten fields from a X1000 fluorescence microscope photograph as in Example 5.

Example 7 Treatment of LC Rat (Intraportal Administration 1)

A LC model rat was prepared using dimethylnitrosamine (DMN) (see Jezequel et al., 1987, J Hepatol. 5:174-81). Specifically, a 1 mL/kg dose of 1% DMN (intraperitoneal administration) was administered to a five week-old male S-D rat three straight days per week. As already reported, an increase in fiber was observed from the 2nd week, and in the 4th week this was accompanied by the findings of marked fibrosis, destruction of hepatic lobule structure, and formation of regenerative nodules being observed. Then, by the same method as in Examples 4 and 5, an emulsion (VA-Lip-gp46siRNA) was prepared by formulating gp46siRNA as a liposome and mixing with 10% VA, and was administered. Administration of VA-Lip-gp46siRNA was started in the 3rd week, by which time sufficient fibrosis was observed, and evaluation was carried out in the 4th and 5th weeks. Since it was confirmed by Example 2 that the effects were observed for up to 48 hours in vitro, administration was carried out twice a week. The amount administered was determined in accordance with a report in which siRNA was directly injected (McCaffery et al., 2002, Nature 418: 38-39), and was 40 µg as the total amount of siRNA. From azan staining of the liver after administration of siRNA, in the 4th week there was no apparent difference between a group to which saline had been administered, a group to which siRNA (random) had been administered, and a group to which siRNA (gp46) had been administered, but in the 5th week a decrease in the amount of fiber was observed for the group to which gp46siRNA had been administered. In order to quantitatively analyze the amount of fiber, an unstained portion was extracted using NIH Image, its area was measured, and a significant decrease in the area of collagen was observed for the group to which gp46siRNA had been administered. Furthermore, in order to evaluate the degree of fibrosis using another measure, the amount of hydroxyproline, which is an indicator for fibrosis, was quantitatively measured by a standard method. Specifically, after 20 mg of freeze-dried hepatic tissue was hydrolyzed with HCl for 24 hours, the reaction liquid was centrifuged, and the supernatant was treated with a reagent such as Ehrlich's solution and centrifuged. The supernatant was recovered, and the amount of hydroxyproline in the hepatic tissue was measured by measuring the absorbance at 560 nm (Hepatology 1998, 28:1247-52). In the group to which gp46siRNA had been administered, the amount of hydroxyproline became very small.

Example 8 Treatment of LC Rat (Intraportal Administration 2)

To examine a change in the survival rate by administration of the therapeutic formulation of the present description, in accordance with a method by Qi Z et al. (PNAS 1999; 96:2345-49), an LC model rat was prepared using DMN in an amount that was increased by 20% over the normal amount. In this model, a total of four intraportal administrations were carried out in the first and second weeks: PBS, Lip-gp46siRNA, VA-Lip-random siRNA, and VA-Lip-gp46siRNA (n=7 for each group). After the third week, all of the controls (the group to which PBS had been administered, the group to which VA-Lip-random siRNA had been administered, and the group to which Lip-gp46siRNA had been administered) were dead, but 6 out of 7 survived for the group to which VA-Lip-gp46siRNA had been administered. Furthermore, in azan staining of the liver on the 21st day, an apparent decrease in the amount of fiber was observed for the group to which gp46siRNA had been administered.

Example 9 Treatment of LC Rat (Intraportal Administration 3)

Additionally, intraportal administration was carried out from the 3rd week for LC model rats (1% DMN 1 mg/kg intraperitoneally administered 3 times a week) prepared in accordance with the method by Qi et al. and a method by Ueki et al., 1999, Nat Med. 5:226-30, as shown in Table 2 below (n=6 for each group). PBS was added to each substance to be administered so as to make a total volume of 200 µL, and the frequency of administration was once a week.

TABLE 2

| Treatment group | Content of Administration | Dosage | Frequency of Administration |
|---|---|---|---|
| 10-1 | VA | VA 200 nmol | Twice a week 10-2 |
| 10-2 | Lip-gp46siRNA | liposome 100 nmol; gp46siRNA 100 µg | |
| 10-3 | VA-Lip-random siRNA | VA 200 nmol; siRNA liposome 100 nmol; random- 100 µg | |
| 10-4 | VA-Lip-gp46siRNA | VA 200 nmol; liposome 100 nmol; gp46siRNA 100 µg | |
| 10-5 | PBS | 200 µL | Three times a week |
| 10-6 | VA | VA 200 nmol | |
| 10-7 | VA-Lip VA | 200 nmol; liposome 100 nmol | |
| 10-8 | Lip-gp46siRNA | liposome 100 nmol; gp46siRNA 150 µg | |
| 10-9 | VA-Lip-random siRNA | VA 200 nmol; liposome 100 nmol; random-siRNA 150 µg | |
| 10-10 | VA-Lip-gp46siRNA | VA 200 nmol; liposome 100 nmol; gp46siRNA 150 µg | |

From the results, in the groups other than the group to which the therapeutic formulation of the present description had been administered (treatment group 9-4), all 6 rats were dead by the 45th day after starting administration of DMN, but in the group to which the therapeutic formulation of the present description had been administered, all of the individuals apart from one case, which was dead on the 36th day, survived for more than 70 days after starting administration of DMN. For the dead individuals, the amount of hepatic fiber was quantitatively analyzed based on the area of collagen in the same manner as in Example 5, and the increase in the amount of hepatic fiber was remarkably inhibited by administration of VA-Lip-gp46siRNA.

Example 10 Treatment of LC Rat (Intravenous Administration)

Intravenous administration was carried out from the 3rd week for LC model rats (1% DMN 1 µg/BW (g) intraperitoneally administered 3 times a week) prepared in the same manner as in Example 9, as shown in the table below (n=6 for each group). PBS was added to each substance to be administered so as to make a total volume of 200 µL. The administration period was up to death except that it was up to the 7th week for Group 10-4 and the 6th week for Group 10-10.

From the results, in the groups other than the groups to which the therapeutic formulation of the present description had been administered (treatment groups 10-4 and 10-10), all 6 rats were dead by the 45th day after starting administration of DMN, but in the groups to which the therapeutic formulation of the present description had been administered, all of the individuals, apart from a case in which two rats were dead on the 45th day in treatment group 10-4, survived for more than 70 days after starting administration of DMN. For the dead individuals, the amount of hepatic fiber was quantitatively analyzed in the same manner as in Example 5, and the increase in the amount of hepatic fiber was remarkably inhibited by administration of VA-Lip-gp46siRNA.

The results show that the therapeutic formulation of the present description is extremely effective for the prevention and treatment of fibrosis, in which stellate cells are involved.

Example 11 Improvement of Results by RBP (Retinol-Binding Protein)

The influence of RBP on VA-Lip-gp46siRNA transfection efficiency was examined using LI90, a cell line derived from human HSC. 100 nM of VA-Lip-gp46siRNA (FITC) prepared in Example 5, together with various concentrations (i.e. 0.0, 0.1, 0.5, 1, 2, 4, or 10%) of FBS (fetal bovine serum), were added to LI90 during culturing and incubated for 48 hours, a fluorescence image was observed by LSM, and the amount of siRNA incorporated into individual cells was quantitatively analyzed by FACS. FBS contained about 0.7 mg/dL of RBP. FBS (RBP) gave a concentration-dependent increase in the amount of siRNA transfection. Subsequently, 100 nM of VA-Lip-gp46siRNA (FITC) and 4% FBS, together with 10 µg (21.476 nmol) of anti-RBP antibody, were added to LI90 during culturing, and the siRNA transfection efficiency was evaluated in the same manner. The increase in the amount of transfection by RBP was markedly decreased by the addition of anti-RBP antibody. The results show that RBP is effective in further enhancing transfection of the therapeutic formulation of the present description.

Example 12 Selecting hsp47 Nucleic Acid Molecule Sequences

Nucleic acid molecules (e.g., siNA<25 nt) against Hsp47 were designed using several computer programs. The sequences of top scored siRNAs from these programs were compared and selected (see Table 3, infra) based on the algorithms as well as the sequence homology between human and rat. Candidate sequences were validated by in vitro knocking down assays.

Several parameters were considered for selecting a nucleic acid molecule (e.g., a 21-mer siRNA) sequence. Exemplary parameters include:

thermodynamic stability (RISC favors the strand with less stable 5'-end)

30-52% GC content positional nucleotide preference:

(C/G)$_1$NNNNNNNN(A/U)$_{10}$NNNNNNNN(A/U)$_{19}$ where N is any nucleotide
devoid of putative immunostimulatory motifs
2-nucleotide 3' overhang
position of siRNA within the transcript (preferably within cDNA region)
sequence specificity (checked by using BLAST)
variations in single nucleotide by checking SNP database iRNA sequences having ≤25 nt were designed based on the foregoing methods. Corresponding Dicer substrate siRNA (e. g., ≥26 nt) were designed based on the smaller sequences and extend the target site of the siNA≤25 nucleotide by adding four bases to the 3'-end of the sense strand and 6 bases to the 5'-end of the antisense strand. The Dicer substrates that were made generally have a 25 base sense strand a 27 base antisense strand with an asymmetric blunt ended and 3'-overhang molecule. The sequences of the sense and the anti-sense strand without base modification (base sequence) and with modifications (experimental sequence) are provided in Table 3.

TABLE 3

| siRNA | Target region | | Base sequence (corresponding nucleotides of SEQ ID NO: 1) | Experimental sequence (corresponding nucleotides of SEQ ID NO: 1) |
|---|---|---|---|---|
| siHSP47-C | human/rat hsp47 | sense | 5' GGACAGGCCUCUACAACUAUU (SEQ ID NO: 3) [945-963] | 5' GGACAGGCCUCUACAACUAdTdT (SEQ ID NO: 5) [945-963] |
| | | anti-sense | 5' UAGUUGUAGAGGCCUGUCCUU (SEQ ID NO: 4) [945-963] | 5' UAGUUGUAGAGGCCUGUCCdTdT (SEQ ID NO: 6) [945-963] |
| siHSP47-Cd | human/rat hsp47 | sense | 5' GGACAGGCCUCUACAACUACUACGA (SEQ ID NO: 7) [945-969] | 5' GGACAGGCCUCUACAACUACUACdGdA (SEQ ID NO: 9) [945-969] |
| | | anti-sense | 5' UCGUAGUAGUUGUAGAGGCCUGUCCUU (SEQ ID NO: 8) [945-969] | 5' UCGUAGUAGUUGUAGAGGCCUGUCCUU (SEQ ID NO: 10) [945-969] |
| siHSP47-1 | human/rat hsp47 | sense | 5' CAGGCCUCUACAACUACUAUU (SEQ ID NO: 11) [948-966] | 5' CAGGCCUCUACAACUACUAdTdT (SEQ ID NO: 13) [948-966] |
| | | anti-sense | 5' UAGUAGUUGUAGAGGCCUGUU (SEQ ID NO: 12) [948-966] | 5' UAGUAGUUGUAGAGGCCUGdTdT (SEQ ID NO: 14) [948-966] |
| siHSP47-1d | human hsp47 | sense | 5' CAGGCCUCUACAACUACUACGACGA (SEQ ID NO: 15) [948-972] | 5' CAGGCCUCUACAACUACUACGACdGdA (SEQ ID NO: 17) [948-972] |
| | | anti-sense | 5' CGUCGUAGUAGUUGUAGAGGCCUGUU (SEQ ID NO: 16) [948-972] | 5' CAGCUUUUCCUUCUCGUCGUCGUAGUU (SEQ ID NO: 2724) [948-972] |
| siHsp47-2 | human hsp47 | sense | 5' GAGCACUCCAAGAUCAACUUU (SEQ ID NO: 19) [698-717] | 5' GAGCACUCCAAGAUCAACUdTdT (SEQ ID NO: 21) [698-717] |
| | | anti-sense | 5' AGUUGAUCUUGGAGUGCUCUU (SEQ ID NO: 20) [698-716] | 5' AGUUGAUCUUGGAGUGCUCdTdT (SEQ ID NO: 22) [698-716] |
| siHsp47-2d | human hsp47 | sense | 5' GAGCACUCCAAGAUCAACUUCCGCG (SEQ ID NO: 23) [698-722] | 5' GAGCACUCCAAGAUCAACUUCCGdCdG (SEQ ID NO: 25) [698-722] |
| | | anti-sense | 5' CGCGGAAGUUGAUCUUGGAGUGCUCUU (SEQ ID NO: 24) [698-722] | 5' GCGGAAGUUGAUCUUGGAGUGCUCUU (SEQ ID NO: 26) [698-722] |
| siHsp47-2d rat | rat Gp46 | sense | 5' GAACACUCCAAGAUCAACUUCCGAG (SEQ ID NO: 27) [587-611] | 5' GAACACUCCAAGAUCAACUUCCGdAdG (SEQ ID NO: 29) [587-611] |
| | | anti-sense | 5' CUCGGAAGUUGAUCUUGGAGUGUUCUU (SEQ ID NO: 28) [587-611] | 5' UCGGAAGUUGAUCUUGGAGUGUUCUU (SEQ ID NO: 30) [587-611] |
| siHsp47-3 | human hsp47 | sense | 5' CUGAGGCCAUUGACAAGAAUU (SEQ ID NO: 31) [1209-1227] | 5' CUGAGGCCAUUGACAAGAAdTdT (SEQ ID NO: 33) [1209-1227] |
| | | anti-sense | 5' UUCUUGUCAAUGGCCUCAGUU (SEQ ID NO: 32) [1209-1227] | 5' UUCUUGUCAAUGGCCUCAGdTdT (SEQ ID NO: 34) [1209-1227] |
| siHsp47-3d | human hsp47 | sense | 5' CUGAGGCCAUUGACAAGAACAAGGC (SEQ ID NO: 35) [1209-1233] | 5' CUGAGGCCAUUGACAAGAACAAGdGdC (SEQ ID NO: 37) [1209-1233] |
| | | anti-sense | 5' CCUUGUUCUUGUCAAUGGCCUCAGUU (SEQ ID NO: 36) [1209-1233] | 5' GCCUUGUUCUUGUCAAUGGCCUCAGUU (SEQ ID NO: 38) [1209-1233] |
| siHsp47-4 | human hsp47 | sense | 5' CUACGACGACGAGAAGGAAUU (SEQ ID NO: 39) [964-982] | 5' CUACGACGACGAGAAGGAAdTdT (SEQ ID NO: 41) [964-982] |
| | | anti-sense | 5' UUCCUUCUCGUCGUCGUAGUU (SEQ ID NO: 40) [964-982] | 5' UUCCUUCUCGUCGUCGUAGdTdT (SEQ ID NO: 42) [964-982] |
| siHsp47-4d | human hsp47 | sense | 5' CUACGACGACGAGAAGGAAAAGCUG (SEQ ID NO: 43) [964-988] | 5' CUACGACGACGAGAAGGAAAAGCdTdG (SEQ ID NO: 45) [964-988] |
| | | anti-sense | 5' AGCUUUUCCUUCUCGUCGUCGUAGUU (SEQ ID NO: 44) [964-988] | 5' CAGCUUUUCCUUCUCGUCGUCGUAGUU (SEQ ID NO: 2727) [964-988] |
| siHsp47-5 | human hsp47 | sense | 5' GCCACACUGGGAUGAGAAAUU (SEQ ID NO: 47) [850-870] | 5' GCCACACUGGGAUGAGAAAdTdT (SEQ ID NO: 49) [850-870] |
| | | anti-sense | 5' UUUCUCAUCCCAGUGUGGCUU (SEQ ID NO: 48) [850-868] | 5' UUUCUCAUCCCAGUGUGGCdTdT (SEQ ID NO: 50) [850-868] |

TABLE 3-continued

| siRNA | Target region | | Base sequence (corresponding nucleotides of SEQ ID NO: 1) | Experimental sequence (corresponding nucleotides of SEQ ID NO: 1) |
|---|---|---|---|---|
| siHsp47-6 | human hsp47 | sense | 5' GCAGCAAGCAGCACUACAAUU (SEQ ID NO: 51) [675-693] | 5' GCAGCAAGCAGCACUACAAdTdT (SEQ ID NO: 53) [675-693] |
| | | anti-sense | 5' UUGUAGUGCUGCUUGCUGCUU (SEQ ID NO: 52) [675-693] | 5' UUGUAGUGCUGCUUGCUGCdTdT (SEQ ID NO: 54) [675-693] |
| siHsp47-7 | human hsp47 | sense | 5' CCGUGGGUGUCAUGAUGAUUU (SEQ ID NO: 55) [921-939] | 5' CCGUGGGUGUCAUGAUGAUdTdT (SEQ ID NO: 57) [921-939] |
| | | anti-sense | 5' AUCAUCAUGACACCCACGGUU (SEQ ID NO: 56) [921-939] | 5' AUCAUCAUGACACCCACGGdTdT (SEQ ID NO: 58) [921-939] |

Example 13

Figure 3:
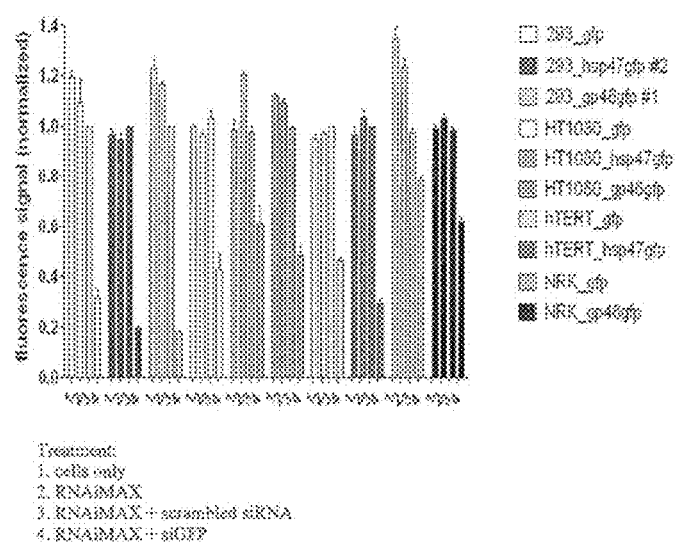
FIG. 3 is a bar graph showing the effect of GFP siNA on various reporter cell lines. Cell lines were established by lenti-viral induction of human HSP47 cDNA-GFP or rat GP46 cDNA-GFP construct into HEK293, human fibrosarcoma cell line HT1080, human HSC line hTERT or NRK cell line. Negative control siNA or siNA against GFP was introduced into the cells and GFP fluorescence was measured. The results showed that siNA against GFP knocks down the fluorescence to different extent in different cell lines. 293_HSP47-GFP and 293_GP46-GFP cell lines were selected for siHsp47 screening due to their easiness of being transfected and sensitivity to fluorescence knockdown.

In order to screen for the potency of various siNA molecules against both the human and rat hsp47 genes, various reporter cell lines were established by lenti-viral induction of human HSP47 cDNA-green fluorescent protein (GFP) or rat GP46 cDNA-GFP construct into 293, HT1080, human HSC line hTERT, or NRK cell lines. These cell lines were further evaluated by siRNA against GFP. The remaining fluorescence signal was measured and normalized to scrambled siRNA (Ambion) and subsequently normalized to cell viability. The results showed that siRNA against GFP knocks down the fluorescence to different extent in different cell lines (FIG. 3). 293_HSP47-GFP and 293_GP46-GFP cell lines were selected for siHsp47 screening due to their ease of transfection and sensitivity to fluorescence knockdown.

Cells were transfected with 1.5 pmol per well of siNA against GFP in 96-well tissue culture plates. Cells were seeded at 6,000 cells per well and mixed with the siNA complexs. Fluorescence readings were taken after 72 hours incubation.

Cells treated with or without siNA were measured for viability after 72 hours incubation. The readings were normalized to samples treated with scrambled siNA molecules.

Figure 4A:
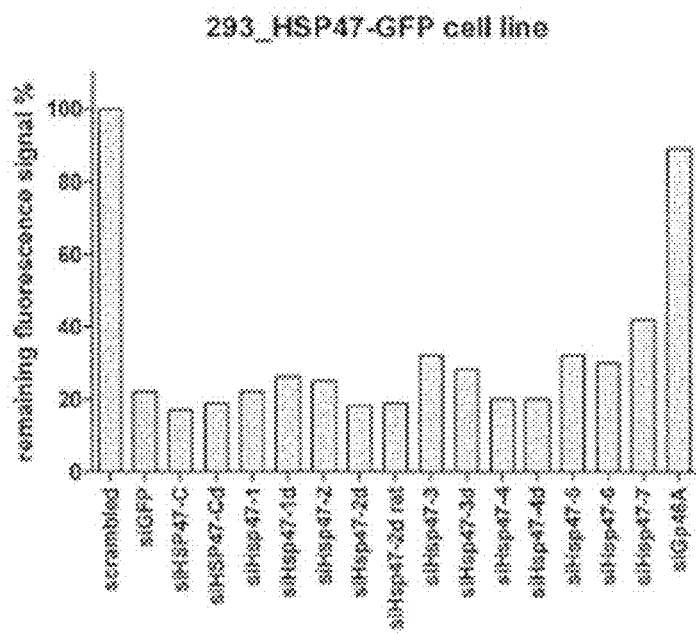
FIGS. 4A, 4B, 4C, and 4D are a series of bar graphs showing the cytotoxicity and knockdown efficiency of various siHsp47s in 293_HSP47-GFP and 293_GP46-GFP cell lines. The result showed that siHsp47-C, siHsp47-2 and siHsp47-2d efficiently knockdown both human HSP47 and rat GP46 (the human hsp47 homolog) without substantial cytotoxicity. siGp46A against GP46 does not knock down human HSP47. Additionally, the newly designed siHsp47s outperformed siGp46A in knocking down rat GP46.
Figure 4B:
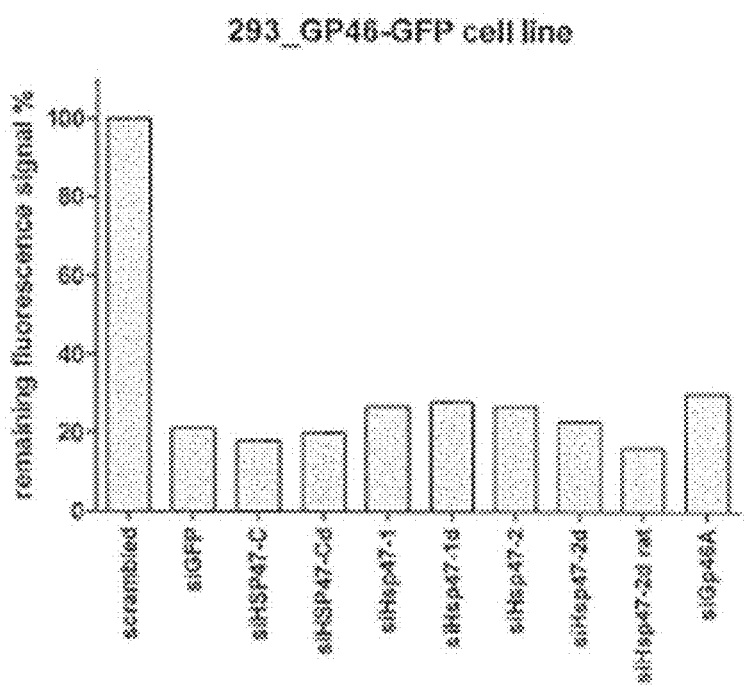
Figure 4C:
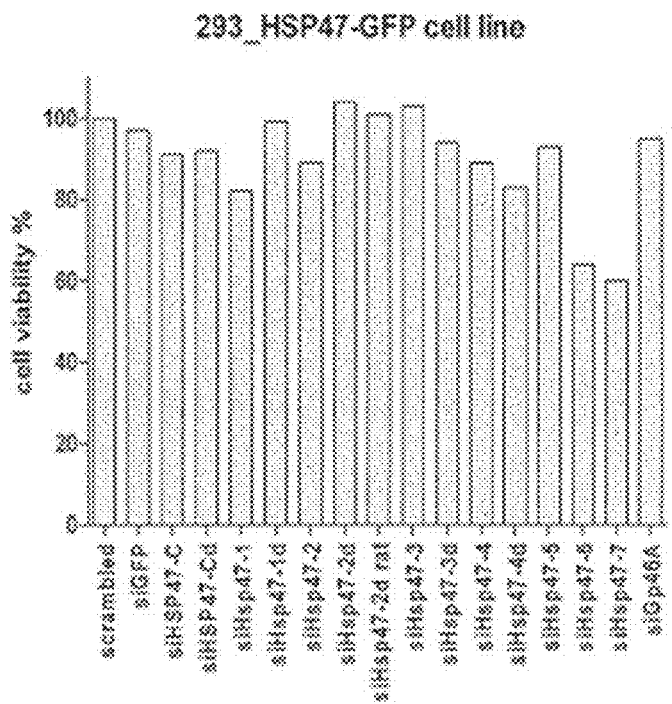
Figure 4D:
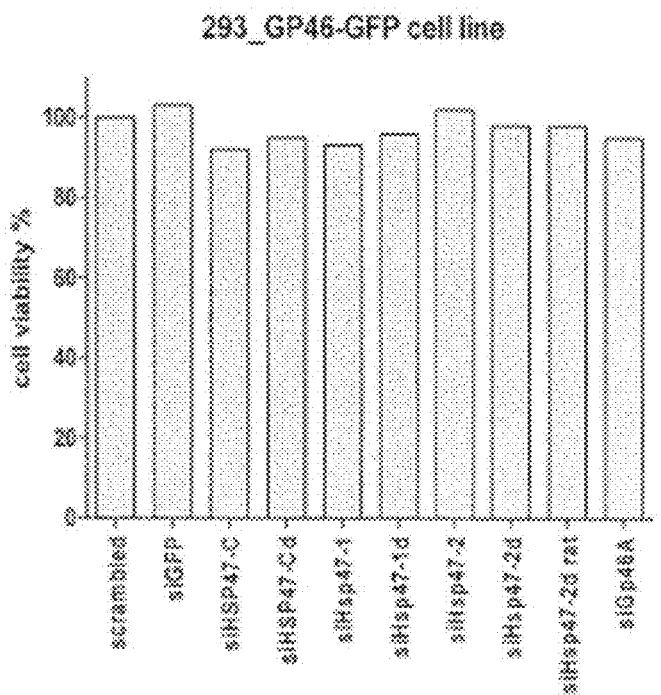

Example 14 Evaluation of Inhibitory Efficiency of siHsp47 on Hsp47 Expression in Reporter Cell Lines siNAs against hsp47 were evaluated for their inhibitory efficiency in 293_HSP47-GFP and 293_GP46-GFP cell lines by evaluating the change in fluorescent signal from the reporter GFP. The experiments were carried out as described in Example 2. The fluorescent signals were normalized to fluorescent signals from cells treated with scrambled siRNA, which served as a control. The results indicate that the tested hsp47 siNA molecules were effective in inhibiting hsp47 mRNA in both cell lines. However, siNA against GP46 mRNA was effective only in the 293_GP46-GFP cell line. The results are shown in FIGS. 4A and 4B The 293_HSP47-GFP and 293_GP46-GFP cell lines treated with siRNA against hsp47 and gp46 were evaluated for viability using the methods described in Example 2. The cell viability was normalized to cells treated with scrambled siRNA. The results indicate that the cell viability was not affected significantly by the treatment with siNA molecules. However, the cell viability of 293_HSP47-GFP cell lines treated with different hsp47 siNA molecules varied depending on the siNA molecules used, while the viability of 293_GP46-GFP cell lines were similar. Viability for 293_HSP47-GFP cells was lower for siHsp47-6 and Hsp47-7 treated cells than the rest. The results are shown in FIGS. 4C and 4D.

Example 15 Evaluation of siHsp47 Inhibitory Effect on Hsp47 mRNA by qPCR

In Example 14, the knock down efficiency of siHsp47s in reporter cell lines was evaluated by change in fluorescent signal. To validate the results at the mRNA level, siRNAs targeting endogenous hsp47 were transfected into cells of the human HSC cell line hTERT using Lipofectamine RNAiMAX (Invitrogen) in a reverse transfection manner as described in Example 13.

Figure 5:
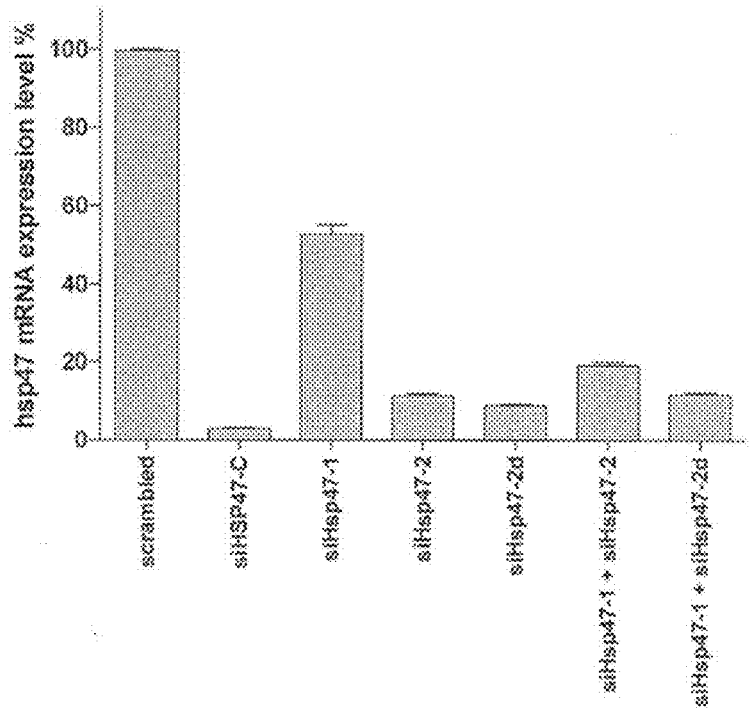
FIG. 5 is a bar graph showing the knock down effect of various siHsp47s on hsp47 mRNA, measured by TAQ-MAN® qPCR using the human HSC cell line hTERT. The Y axis represents the remaining mRNA level of hsp47. HSP47-C was most effective among all the hsp47 siNAs tested.

The hsp47 mRNA level was evaluated for knock down efficiency of the various tested siHsp47 siNA molecules. Briefly, mRNA were isolated from hTERT cells 72 hours after transfection. The level of hsp47 mRNA was determined by reverse transcription coupled with quantitative PCR using TAQMAN® probes. Briefly, cDNA was synthesized and assayed. The level of hsp47 mRNA was normalized to the level of GAPDH mRNA. The results indicated that siHsp47-C was the most effective among all the hsp47 siRNAs, siHsp47-2 and siHsp47-2d were the next most effective. The combinations of siHsp47-1 with siHsp47-2 or siHsp47-1 with siHsp47-2d were more effective than siHsp47-1 alone. The results are shown in FIG. 5.

Example 16 Validation of siHsp47 Knock Down Effect at the Protein Level

The inhibitory effect of different Hsp47 siNA molecules (siHsp47) on hsp47 mRNA expression were validated at the protein level by measuring the HSP47 in hTERT cells transfected with different siHsp47. Transfection of hTERT cells with different siHsp47 were performed as described in Example 13. Transfected hTERT cells were lysed and the cell lysate were clarified by centrifugation. Proteins in the clarified cell lysate were resolved by SDS polyacrylamide gel electrophoresis. The level of HSP47 protein in the cell lysate were determined using an anti-HSP47 antibody as the primary antibody, Goat anti-mouse IgG conjugated with HRP as the secondary antibody, and subsequently detected by chemiluminescence. Anti-actin antibody was used as a protein loading control. The results showed significant decrease in the level of Hsp47 protein in cells treated with siHsp47-C, siHsp47-2d, alone or combination of siHsp47-1 with siHsp47-2d.

Example 17 Downregulation of Collagen I Expression by Hsp47 siRNA

Figure 6:
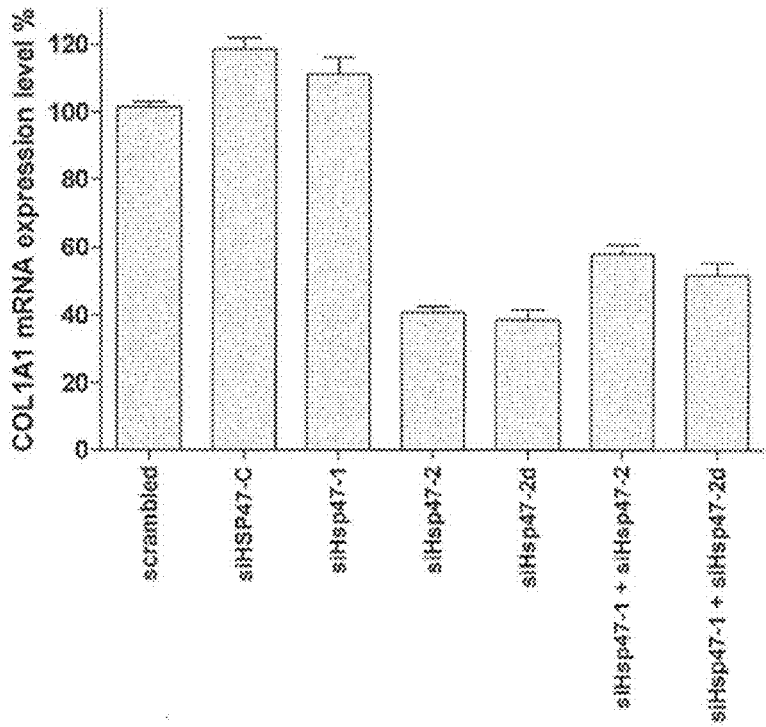
FIG. 6 is a bar graph showing the effect of different hsp47 siNAs on collagen I expression in hTERT cells. The level of collagen I mRNA levels were measured by real-time quantitative PCR using TAQMAN® probe. The Y axis represents the remaining mRNA expression level of collagen I. The result showed that collagen I mRNA level is significantly reduced in the cells treated with some of the candidates (siHsp47-2, siHsp47-2d, and their combination with siHsp47-1).

To determine the effect of siHsp47 on collagen I expression level, collagen I mRNA level in hTERT cells treated with different siRNA against hsp47 was measured. Briefly, hTERT cells were transfected with different siHsp47 as described in Example 13. The cells were lysed after 72 hours and mRNA was isolated. The level of collagen I mRNA was determined by reverse transcription coupled with quantitative PCR using TAQMAN® probes. Briefly, cDNA synthesis was carried out, and assayed. The level of collagen I mRNA was normalized to the level of GAPDH mRNA. The signals were normalized to the signal obtained from cells transfected with scrambled siNA. The result indicated that collagen I mRNA level is significantly reduced in the cells treated with some of the candidates siHsp47-2, siHsp47-2d, and their combination with siHsp47-1 and shown in FIG. 6.

Example 18 Immunofluorescence Staining of Hsp47 siRNA Treated hTERT Cells

To visualize the expression of two fibrosis markers, collagen I and alpha-smooth muscle actin (SMA), in hTERT cells transfected with or without siHsp47, the cells were stained with rabbit anti-collagen I antibody and mouse anti-alpha-SMA antibody. A goat anti-mouse IgG and a goat anti-rabbit IgG were used as secondary antibodies to visualize collagen I (green) and alpha-SMA (red). Hoescht was used to visualize nuleus (blue). The results indicate correlation between siRNA knocking down of some of the target genes and collagen/SMA expression.

Example 19 In Vivo Testing of siHSP47 in Animal Models of Liver Fibrosis

The siRNA duplex sequence for HSP47 (siHSP47C) is as listed below.

```
Sense (5'->3')
                                    (SEQ ID NO: 2731)
ggacaggccucuacaacuaTT Antisense (5'->3')
                                    (SEQ ID NO: 2732)
uaguuguagaggccuguccTT
```

10 mg/ml siRNA stock solution was prepared by dissolving in nuclease free water (Ambion). For treatment of cirrhotic rats, siRNA was formulated with vitamin A-coupled liposome in order to target activated HSC that produce collagen. The vitamin A (VA)-liposome-siRNA formulation consists of 0.33 µmol/ml of VA, 0.33 µmol/ml of liposome (COATSOME® EL, NOF Corporation) and 0.5 µg/µl of siRNA in 5% glucose solution.

Four week-old male SD rats were induced with liver cirrhosis with 0.5% dimethylnitrosoamine (DMN) in phosphate-buffered saline (PBS). A dose of 2 ml/kg per body weight was administered intraperitoneally for 3 consecutive days per week on days 0, 2, 4, 7, 9, 11, 14, 16, 18, 21, 23, 25, 28, 30, 32, 34, 36, 38 and 40.

siRNA treatment: siRNA treatment was carried out from day 32 and for 5 intravenous injections. In detail, rats were treated with siRNA on day-32, 34, 36, 38 and 40. Then rats were sacrificed on day-42 or 43. 3 different siRNA doses (1.5 mg siRNA per kg body weight, 2.25 mg siRNA per kg body weight, 3.0 mg siRNA per kg body weight) were tested.

Detail of tested groups and number of animals in each group are as follows in which VA-Lip refers to vitamin A—liposome complex.

1) Cirrhosis was induced by DMN injection, then 5% glucose was injected instead of siRNA) (n=10)

2) VA-Lip-siHSP47C 1.5 mg/kg (n=10)
3) VA-Lip-siHSP47C 2.25 mg/kg (n=10)
4) VA-Lip-siHSP47C 3.0 mg/Kg (n=10)
5) Sham (PBS was injected instead of DMN; 5% Glucose was injected instead of siRNA) (n=6)
6) No treatment control (Intact) (n=6)

Evaluation of therapeutic efficacy: On day 43, 2 out of 10 animals in the "diseased rat" group and 1 out of 10 animals in "VA-Lip-siHSP47C siRNA 1.5 mg/kg" died due to development of liver cirrhosis. The remainder of the animals survived. After rats were sacrificed, liver tissues were fixed in 10% formalin. Then, the left lobule of each liver was embedded in paraffin for histology. Tissue slides were stained with Sirius red, and hematoxylin and eosin (HE). Sirius red staining was employed to visualize collagen-deposits and to determine the level of cirrhosis. HE staining was for nuclei and cytoplasm as counter-staining. Each slide was observed under a microscope and percentage of Sirius red-stained area per slide was determined by image analysis software attached to the microscope. At least four slides per each liver were prepared for image analysis, and whole area of each slide (slice of liver) was captured by camera and analyzed. Statistical analysis was carried out by Student's t-test.

Figure 7:
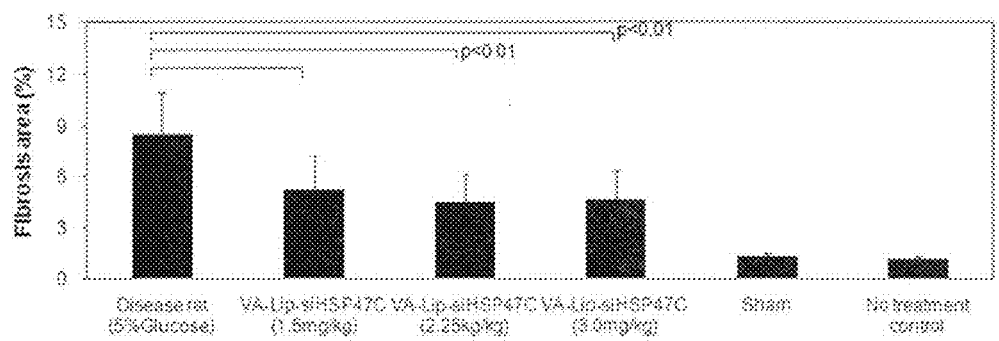
FIG. 7 is a graph showing a decrease in fibrotic areas of the liver in animals treated with siHSP47.

FIG. 7 shows the fibrotic areas. The area of fibrosis in "diseased rats" was higher than in the "sham" or "no treatment control" groups. Therefore, DMN treatment induced collagen deposition in the liver, which was a typical observation of liver fibrosis. However, the area of fibrosis was significantly reduced by the treatment of siRNA targeting HSP47 gene, compared with "disease rat" group, indicating that siRNA has a therapeutic efficacy in actual disease.

Additional siRNA compounds are tested in the liver fibrosis animal model, and were shown to reduce the fibrotic area in the liver.

Example 20 Generation of Sequences for dsRNA to HSP47/SERPINH1

Duplexes are generated by annealing complementary single-stranded oligonucleotides. In a laminar flow hood, a 500 µM stock solution of single-stranded oligonucleotide is prepared by diluting in water. Actual ssRNA concentrations are determined by diluting each 500 µM ssRNA 1:200 and measuring the OD. The procedure is repeated 3 times and the average concentration is calculated. The stock solution was then diluted to a final concentration of 250 µM. Complementary single-strands were annealed by heating to 85° C. and allowing to cool to room temperature over at least 45 minutes. Duplexes were tested for complete annealing by testing 5 µl on a 20% polyacrylamide gel and staining. Samples were stored at −80° C.

Tables 4, 5, B, C, D and E of US 20140356413 provide siRNAs for HSP47/SERPINH1 and siRNA oligonucleotides useful in generating double-stranded RNA molecules. Table 4 provides SEQ ID NOs: 60-193, Table 5 provides SEQ ID NOs: 194-243, Table B provides additional active 19-mer SERPINH1 siRNAs (SEQ ID NOs: 244-675), Table C provides cross-species 19-mer SERPINH1 siRNAs (SEQ ID NOs: 676-1269), Table D provides SERPINH1 active 18+1-mer siRNAs (SEQ ID NOs: 1270-2427) and Table E provides SERPINH1 cross-species 18+1-mer siRNAs (SEQ ID NOs: 2428-2723).

The most active sequences were selected from further assays as shown in Tables 4-A and 4-B, which include siRNA compounds SERPINH1_2, SERPINH1_6, SER- PINH1_13, SERPINH1_45 SERPINH1_45a, SERPINH1_51, SERPINH1_51a, SERPINH1_52 and SERPINH1_86.

TABLE 4-A

Select siRNAs

| siRNA | SEQ ID SEN | SEQ ID AS | Activity 0.1 nM | Activity 0.5 nM | Activity 5 nM | IC50 (nM) | Length |
|---|---|---|---|---|---|---|---|
| SERPINH1_2 | 60 | 127 | 65 | 48 | 7 | .008 | 19 |
| SERPINH1_6 | 63 | 130 | 164 | 39 | 5 | .019 | 19 |
| SERPINH1_11 | 68 | 135 | 119 | 54 | 6 | .05 | 19 |
| SERPINH1_13 | 69 | 136 | 91 | 24 | 4 | | 19 |
| SERPINH1_45 | 97 | 164 | 156 | 38 | 8 | .07 | 19 |
| SERPINH1_45a | 98 | 165 | | | | | 19 |
| SERPINH1_51 | 101 | 168 | 68 | 39 | 5 | .05 | 19 |
| SERPINH1_52 | 102 | 169 | 149 | 37 | 9 | 0.06 | 19 |
| SERPINH1_86 | 123 | 190 | 121 | 61 | | 0.27 | 19 |

TABLE 4-B

| siRNA | SEQ ID SEN | SEQ ID AS | Activity 0.026 nM | Activity 0.077 nM | Activity 0.23 nM | Activity 0.69 nM | Activity 2.1 nM | Activity 6.25 nM | Activity 25 nM |
|---|---|---|---|---|---|---|---|---|---|
| SERPINH1_45 | 97 | 164 | 102 | 81 | 55 | 41 | 28 | 22 | 16 |
| SERPINH1_45a | 98 | 165 | 107 | 98 | 84 | 69 | 36 | 24 | 16 |

Table 5 lists preferred siRNA compounds SERPINH1_4, SERPINH1_12, SERPINH1_18, SERPINH1_30, SERPINH1_58 and SERPINH1_88.

TABLE 5

Select siRNAs

| siRNA | SEQ ID NO SEN | SEQ ID NO AS | Activity 0.1 nM | Activity 0.5 nM | Activity 5 nM | IC50 (nM) | Length |
|---|---|---|---|---|---|---|---|
| SERPINH1_4 | 195 | 220 | 60 | 35 | 5 | .006 | 19 |
| SERPINH1_12 | 196 | 221 | 54 | 42 | 8 | .065 | 19 |
| SERPINH1_18 | 197 | 222 | 139 | 43 | 9 | | 19 |
| SERPINH1_30 | 199 | 224 | 146 | 49 | 9 | 0.093 | 19 |
| SERPINH1_58 | 208 | 233 | na | na | 8 | | 19 |
| SERPINH1_88 | 217 | 242 | 105 | 43 | 9 | | 19 |

Example 21 Animal Model Systems of Fibrotic Conditions

Testing the active siRNAs of the description may be done in predictive animal models. Rat diabetic and aging models of kidney fibrosis include Zucker diabetic fatty (ZDF) rats, aged fa/fa (obese Zucker) rats, aged Sprague-Dawley (SD) rats, and Goto Kakizaki (GK) rats; GK rats are an inbred strain derived from Wistar rats, selected for spontaneous development of NIDDM (diabetes type II). Induced models of kidney fibrosis include the permanent unilateral ureteral obstruction (UUO) model which is a model of acute interstitial fibrosis occurring in healthy non-diabetic animals; renal fibrosis develops within days following the obstruction. Another induced model of kidney fibrosis is 5/6 nephrectomy.

Two models of liver fibrosis in rats are the Bile Duct Ligation (BDL) with sham operation as controls, and $CCl_4$ poisoning, with olive oil fed animals as controls, as described in the following references: Lotersztajn S, et al., Annu Rev Pharmacol Toxicol. 2004 Oct. 7; Uchio K, et al., Wound Repair Regen. 2004 January-February; 12(1):60-6; Xu X Q, et al., Proteomics. 2004 October; 4(10):3235-45.

Models for ocular scarring are well known in the art, e.g. Sherwood M B et al., J Glaucoma. 2004 October; 13(5): 407-12; Miller M H et al., Ophthalmic Surg. 1989 May; 20(5):350-7; vanBockxmeer F M et al., Retina. 1985 Fall-Winter; 5(4): 239-52; Wiedemann P et al., J Pharmacol Methods. 1984 August; 12(1): 69-78.

Models of cataract are known (Zhou et al., 2002. Invest Ophthalmol Vis Sci. 43:2293-300; Wang et al. 2004 Curr Eye Res. 29:51-58).

The compounds are tested in these models of fibrotic conditions, in which it is found that they are effective in treating liver fibrosis and other fibrotic conditions.

Model Systems of Glaucoma

Testing the active siRNA of the description for treating or preventing glaucoma is performed in a rat animal model for optic nerve crush described (Maeda et al., 2004 IOVS, 45:851). Specifically, for optic nerve transection the orbital optic nerve (ON) of anesthetized rats is exposed through a supraorbital approach, the meninges severed and all axons in the ON transected by crushing with forceps for 10 seconds, 2 mm from the lamina cribrosa.

Nucleic acid molecules as disclosed herein are tested in this animal model and the results show that these siRNA compounds are useful in treating and/or preventing glaucoma.

Rat Optic Nerve Crush (ONC) Model: Intravitreal siRNA Delivery and Eye Drop Delivery For optic nerve transsection the orbital optic nerve (ON) of anesthetized rats is exposed through a supraorbital approach, the meninges severed and all axons in the ON transected by crushing with forceps for 10 seconds, 2 mm from the lamina cribrosa.

The siRNA compounds are delivered alone or in combination in 5 uL volume (10 ug/uL) as eye drops. Immediately after optic nerve crush (ONC), 20 ug/10 ul test siRNA or 10 ul PBS is administered to one or both eyes of adult Wistar rats and the levels of siRNA taken up into the dissected and snap frozen whole retinae at 5 h and 1 d, and later at 2 d, 4 d, 7 d, 14 d and 21 d post injection is determined. Similar experiments are performed in order to test activity and efficacy of siRNA administered via eye drops.

Model Systems of Ischemia Reperfusion Injury Following Lung Transplantation in Rats Lung ischemia/reperfusion injury is achieved in a rat animal model (Mizobuchi et al., 2004 J Heart Lung Transplantation, 23 and in Kazuhiro et al., 2001 Am. J. Respir. Cell Mol Biol, 25:26-34).

Specifically, after inducing anesthesia with isofluorane, the trachea is cannulated with a 14-gauge TEFLON™ catheter and the rat is mechanically ventilated with rodent ventilator using 100% oxygen, at a rate of 70 breaths per minute and 2 cm $H_2O$ of positive end-respiratory pressure. The left pulmonary artery, veins and main stem bronchus are occluded with a Castaneda clamp. During the operation, the lung is kept moist with saline and the incision is covered to minimize evaporative losses. The period of ischemia is 60 minutes long. At the end of the ischemic period the clamp is removed and the lung is allowed to ventilate and reperfuse for further 4 h, 24 h, and 5 d post induction of lung ischemia. At the end of the experiment, the lungs are gently harvested and either frozen for RNA extraction or fixed in glutaraldehyde cocktail for subsequent histological analysis.

The Bleomycin Animal Model as a Model for Idiopathic Pulmonary Fibrosis (IPF)

Testing feasibility of lung and liver delivery of vitamin A-COATSOME® formulated siRNA administered by intravenous injection and intratracheal administration of siRNA-vitaminA-COATSOME® complex to a healthy mice and bleomycine-treated mice Objective: To test two administration routes for feasibility of vitamin A-Coatsome formulated siRNA delivery to normal and fibrotic mouse lungs. The main hypothesis to be tested in the current study is whether systemic administration of vitaminA-COATSOME® formulated modified siRNA provides efficient uptake and cell-specific distribution in the fibrotic and normal mouse lungs. Intratracheal route of vitaminA-COATSOME® formulated modified siRNA will be tested in parallel. siRNA detection and cell-specific distribution in the lungs and liver will be performed by in situ hybridization (ISH)

The Bleomycin model of pulmonary fibrosis has been previously developed and characterized (Moeller, et al. 2008Int J Biochem Cell Biol, 40:362-82; Chua et al., 2005 Am J Respir Cell Mol Biol 33:9-13). Histological hallmarks, such as intra-alveolar buds, mural incorporation of collagen and obliteration of alveolar space are present in BLM-treated animals similar to IPF patients. Early studies demonstrated that C57/Bl mice were consistently prone to BLM-induced lung fibrosis, whereas Balb/C mice were inherently resistant. Depending on the route of administration, different fibrotic pattern develops. Intratracheal instillation of BLM results in bronchiocentric accentuated fibrosis, whereas intravenous or intraperitoneal administration induces subpleural scarring similar to human disease (Chua et al. ibid.). A mouse model of usual interstitial pneumonia (UIP) is used. This model shows a heterogenous distribution of fibroproliferation, distributed mainly subpleurally, forming similar lesions to those observed in the lungs of patients with idiopathic pulmonary fibrosis (IPF) (Onuma, et al., 2001 J Exp Med 194:147-56, and Yamaguchi et al., 1988 Nature 336:244-46). UIP will be induced by intraperitoneal injection of bleomycin every other day for 7 days for a constant composition of subpleural fibroproliferation in the mouse lung (Swiderski et al. 1998 Am J Pathol 152: 821-28, and Shimizukawa et al., 2003 Am J Physiol Lung Cell Mol Physiol 284: L526-32).

Vitamin A-loaded liposomes containing siRNA interact with retinol-binding protein (RBP) and provide efficient delivery to the HSC via RBP receptor. These liposomes are efficiently taken up by an RBP receptor-expressing activated myofibroblasts in the lungs of bleomycin-treated mice.

Study Design

Mice—C57 Bl male

Starting N (BLM I.P.)—40 (6 for the first pilot group, 34 for the study, taking in consideration anticipated 25% mortality)

Starting N (Total)—60

Test siRNA: SERPINHI compounds disclosed herein.

TABLE 8

| | Groups: | | | | | | | |
|---|---|---|---|---|---|---|---|---|
| No | BLM dose, mg/kg BW, in 0.1 ml saline | BLM adm. route | BLM regime | siRNA dose, mg/kg BW | siRNA adm route | siRNA regime | Termination post last siRNA adm | N (before siRNA administration) |
| 1 | 0.75 | I.P. | dd 0, 2, 4, 6 | 4.5 | I.V. | 2 daily | 2 h | 4 |
| 2 | 0.75 | I.P. | dd 0, 2, 4, 6 | 4.5 | I.V. | 2 daily | 24 h | 4 |
| 3 | 0.75 | I.P. | dd 0, 2, 4, 6 | 2.25 | I.T. | 2 daily | 2 h | 4 |
| 4 | 0.75 | I.P. | dd 0, 2, 4, 6 | 2.25 | I.T. | 2 daily | 24 h | 4 |
| 5 | | intact | n/a | 4.5 | I.V. | 2 daily | 2 h | 4 |
| 6 | | intact | n/a | 4.5 | I.V | 2 daily | 24 h | 4 |
| 7 | | intact | n/a | 2.25 | I.T | 2 daily | 2 h | 4 |
| 8 | | intact | n/a | 2.25 | I.T. | 2 daily | 24 h | 4 |
| 9 | 0.75 | I.P. | dd 0, 2, 4, 6 | n/a | I.V. vehicle | 2 daily | 2 h | 3 |
| 10 | 0.75 | I.P. | dd 0, 2, 4, 6 | n/a | I/T/vehicle | 2 daily | 24 h | 3 |
| 11 | | Intact | n/a | n/a | intact | n/a | Any time | 3 |

Bleomycin-Induced Pulmonary Fibrosis.

Pulmonary fibrosis of 12-wk-old female C57BL/6 mice will be induced by intraperitoneal instillation of bleomycin chlorate: 0.75 mg/kg body weight dissolved in 0.1 ml of saline every other day for 7 days, on days 0, 2, 4, and 6.

Pilot Evaluation of the Establishment of Fibrosis.

The mice (N=30) are subjected to BLM treatment in groups, to allow for a one week time interval between the first treated group (N=5) and the rest of the animals. On day 14, two mice from the first group are sacrificed and the lungs harvested for the fast HE stain and quick histopathological evaluation of fibrosis. When lung fibrosis is confirmed, the remaining rats are sorted into the groups and treated with siRNA on Day 14 after the first BLM treatment. In case that no sufficient fibrosis develops in the lungs by day 14, the remaining mice from the first treated group are sacrificed on day 21, followed by quick histopathology evaluation of fibrosis. The rest of the animals are treated with test siRNA complex starting from day 21 after the BLM treatment.

siRNA Administration.

On day 14 or day 21 after the first BLM administration (TBD during the study, based on pilot evaluation of establishment of fibrosis), the animals are group sorted, according to BW. The animals from groups 1 and 2 are administered intravenously (tail vein injection) with siRNA/vitaminA-COATSOME® complex, at an siRNA concentration of 4.5 mg/kg BW. Intact animals of the same age (Groups 5 and 6) are treated in the same manner. BLM treated animals (Group 9) will be used as vitaminA-COATSOME® vehicle control). In 24 hours, the injection is repeated to all the animals, as above.

The BLM animals from the groups 3 and 4, and intact mice from groups 7 and 8 are anesthetized with isoflurane and subjected to intratracheal instillation of 2.25 mg/kg BW siRNA formulated in vitA-loaded liposomes. Mice from the BLM group 10 are administered with vitaminA-COATSOME® vehicle only. The intratracheal instillation is repeated after 24 hours.

Study Termination.

The animals from the groups 1, 3, 5, 7, 9 are sacrificed at 2 hours after the second siRNA complex injection or instillation. The animals from the groups 2, 4, 6, 8, 10 are sacrificed at 24 hours after the second siRNA complex injection or instillation.

Upon animals sacrifice, the mice are perfused transcardially with 10% neutral buffered formalin. The lungs are inflated with 0.8-1.0 ml of 10% NBF, and the trachea ligated. The lungs are excised and fixed for 24 h in 10% NBF. The liver is harvested from each animal and fixed in 10% NBF for 24 h.

Sectioning and Evaluation.

Consequent sections are prepared from the lungs and livers. First consequent section are stained with hematoxylin and eosin for assessment of lung and liver morphology, second section are stained with Sirius Red (trichrome) to identify collagen The third consequent sections are subjected to in situ hybridization (ISH) for detection of siRNA.

Example 22: In Vivo Anti-Pulmonary-Fibrosis Activity of VA-Bound Liposome (1) Induction of Pulmonary Fibrosis and Administration of Drug Male S-D rats (8 rats/group, 8 weeks old) were administered once with 0.45 mg bleomycin (BLM) dissolved in 0.1 mL of saline into the lung by intratracheal cannulation under anesthesia, to produce a bleomycin pulmonary fibrosis model. With this method, a significant fibrosis occurs in the lung generally after approximately 2 weeks. The liposome formulation (1.5 mg/kg as an amount of siRNA, 1 ml/kg in volume, i.e., 200 µl for a rat of 200 g) or PBS (1 ml/kg in volume) was administered to the rats via the tail vein, starting from the 2 weeks after the bleomycin administration, for total of ten times (every other day). The rats were sacrificed at two days post last treatment, histological investigation of the lung tissue was performed. One way ANOVA and Bonferroni multi comparison test was used for the evaluation of statistically-significant difference.

The composition of the liposome was HEDC/S-104/DOPE/Cholesterol/PEG-DMPE/diVA-PEG-diVA (20:20:30:25:5:2 Molar %). Details of siRNA were as follows:

```
S strand:
5'-idAB-rG-rA-rG-rA-rC-rA-rC-rA-rU-rG-rG-rG-rU-rG-
25rC-25rU-25rA-25rU-25rA-C3-P-3' SEQ ID NO: 2748

AS strand:
5'-mU-rA-mU-rA-mG-rC-25rA-rC-mC-rC-mA-rU-mG-rU-mG-
rU-mC-rU-mC-C3-C3-3' SEQ ID NO: 2749
``` wherein: rX represents ribonucleotides; mX represents 2'-O-methyl ribonucleotides; 25rX represents ribonucleotides with 2'-5' linkages; C3 represents a 1,3-propanediol spacer; idAB represents inverted 1,2-dideoxy-D-ribose; P represents a phosphate group on the 3'-terminus. The 3'-terminus C3 is introduced by support-loaded 1,3-propanediol spacer. The 3'-terminus phosphate group (P) is introduced by the use of support-loaded diethyl sulfonyl (Pi) spacer.

(2) Histological Investigation.

A part of the removed lung was formalin-fixed in accordance with a routine method, and subjected to azan staining (azocarmine, aniline blue orange G solution). The results of the azan staining showed that in the PBS administration group, a noticeable fibrotic image characterized by enlargement of interstice due to a large quantity of blue-stained collagenous fibrils was observed, whereas in the formulation administration group, fibrosis were apparently suppressed.

Figure 8:
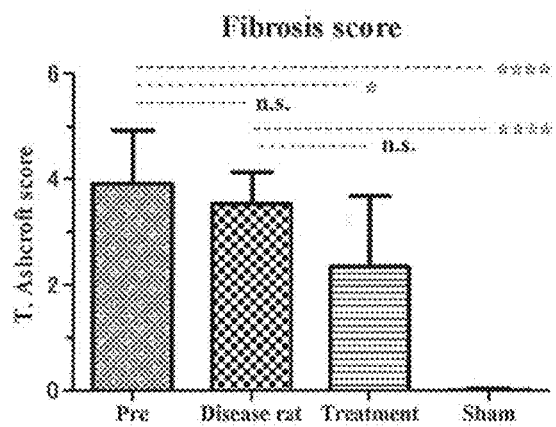
FIG. 8 shows fibrosis scoring, showing the results of evaluating twenty randomly selected lung fields under 80× magnification for each rat. The bar graph summarizes the fibrosis scoring of Azan-stained section for each group. Statistical analysis were used One-way-ANOVA Bonferroni multi comparison test using Prism5 software.

The results of histological scoring (T Ashcroft score, FIG. 8) showed that in the formulation administration group, fibrosis score was significantly decreased.

Example 23: In-Vivo Reduction of HSP47 mRNA (DMN Model)

In vivo activity of the HSP47 liposomes of Example 22 was evaluated in the short-term liver damage model (referred to as the Quick Model). In this model, the short-term liver damage induced by treatment with a hepatotoxic agent such as dimethylnitrosamine (DMN) is accompanied by the elevation of HSP47 mRNA levels. To induce these changes, male Sprague-Dawley rats were injected intraperitoneally with DMN on six consecutive days. At the end of the DMN treatment period, the animals were randomized to groups based upon individual animal body weight. The liposome sample was administered as a single IV dose (0.375 or 0.75 mg/kg, reflecting the siRNA dose) one hour after the last injection of DMN. One day later, liver lobes were excised and both HSP47 and GAPDH mRNA levels were determined by quantitative RT-PCR assay. HSP47 mRNA levels were normalized to GAPDH levels. Robust and dose-dependent mRNA reduction for HSP47 was detected in liver. After a single dose of 0.75 mg/kg of ND-L02-0101, 80% reduction of HSP47 mRNA was observed. Even at the lower dose of 0.375 mg/kg, significant knockdown of 40% was observed.

Example 24: Preparation of 2-(bis(2-(tetradecanoyloxy)ethyl)amino)-N-(2-hydroxyethyl)-N,N-dimethyl-2-oxoethan-aminium bromide (HEDC) (FIGS. 9A-9D)

Figure 9A:
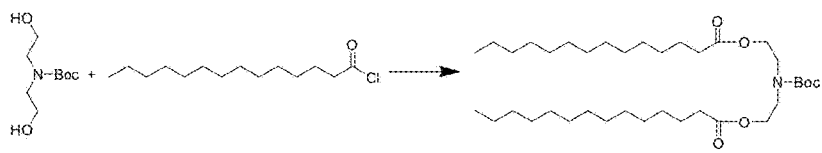

Preparation of 2,2'-(tert-butoxycarbonylazanediyl)bis(ethane-2,1-diyl) ditetradecanoate (HEDC-BOC-IN) (FIG. 9A). A solution of N-BOC-diethanolamine (194 g, 0.946 mol), triethylamine (201 g, 2.03 mol) and diaminopyridine (23.1 g, 0.19 mol) in dichloromethane (DCM) (1750 mL) was cooled to 0° C. A solution of myristoyl chloride (491 g, 1.99 mol) in DCM (440 mL) was added for 50 minutes at 0-10° C., and the mixture was warmed to ambient temperature. Full conversion was indicated by thin layer chromatography (TLC) after 1.5 hours at 20-24° C. Water (1750 mL) was added and pH 8.3 was measured by a pH meter. The organic phase was separated, washed with (1) 6% NaHCO$_3$ (500 mL), (2) 0.3 M HCl (1700 mL), (3) 12.5% sodium chloride (1700 mL), and dried with anhydrous magnesium sulphate (120 g). Evaporation of the filtrate at 50° C. and 50 mBar gave 622 g of 2,2'-(tert-butoxycarbonylazanediyl)bis(ethane-2,1-diyl) ditetradecanoate, (HEDC-BOC-IN). This residue was used in the next step.

Figure 9B:
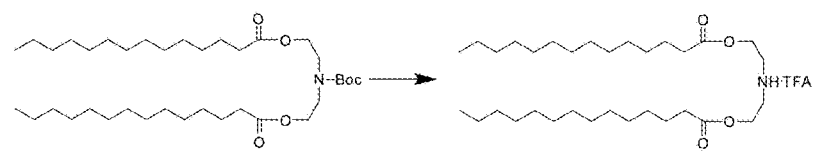
FIG. 9B shows preparation of HEDC-amine-IN TFA salt.

Preparation of 2,2'-(tert-butoxycarbonylazanediyl)bis(ethane-2,1-diyl) ditetradecanoate (HEDC-amine-IN) TFA salt (FIG. 9B). HEDC-BOC-IN (620 g, 0.990 mol) was transformed into a liquid by brief heating into a 50° C.-bath and then cooled below 25° C. Trifluoroacetic acid (TFA) (940 mL, 1.39 kg, 1.18 mol) was added to the liquid for 30 minutes, using moderate cooling in order to maintain a temperature not higher than 25° C. Having added two thirds of the amount of TFA, significant gas evolution was observed. The reaction mixture was stirred overnight at ambient temperature. TLC indicated traces of HEDC-BOC-IN. The reaction mixture was heated for distillation of TFA under reduced pressure (125-60 mBar) from a water bath of 50-55° C., and distillation was continued. TFA fumes were absorbed in a scrubber with 10% sodium hydroxide. Heptane (2000 mL) was added, stirred, and distilled off under reduced pressure. Heptane (2000 mL) was added to the partly solidified residue, and the mixture was heated to 45° C., at which temperature a slightly turbid solution was formed. The solution was cooled, seeded at 40° C., and precipitate was formed by stirring for 25 minutes at 40-36° C. After cooling and stirring for 40 minutes at ambient temperature, the precipitate of heavy crystals was isolated by filtration, and the filter cake was washed with heptane (1000 mL). The wet filter cake (914 g) was dried overnight at ambient temperature under reduced pressure (<1 mBar) to give 635 g (100%) of 2,2'-(tert-butoxycarbonylazanediyl) bis(ethane-2,1-diyl) ditetradecanoate (HEDC-amine-IN) TFA salt as white crystals.

Figure 9C:
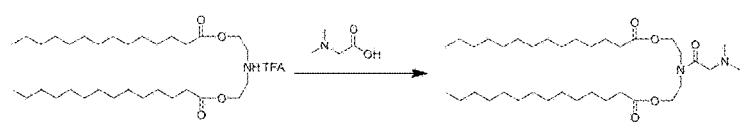

Preparation of 2,2'-(2-(dimethylamino)acetylazanediyl) bis(ethane-2,1-diyl) ditetradecanoate (HEDC-DiMeGly-IN) (FIG. 9C). N,N-dimethylglycine (56.6 g, 548 mmol), 1-hydroxybenzotriazole (HOBt) hydrate (83.9 g, 548 mmol) and N-(3-dimethylaminopropyl)-N'-ethylcarbodiimide hydrochloride (EDC) (105 g, 548 mmol) were added to dimethylformamide (DMF) (3.5 L), and the mixture was stirred at ambient temperature for one hour. A clear solution was formed. HEDC-amine-IN TFA salt (270 g, 442 mmol) was mixed with DCM (1.15 L) and 6% sodium bicarbonate (1.15 L). The separated organic phase with the free amine was added to the coupling mixture in DMF, and a precipitation as well as a temperature increase of about 9° C. was observed. Triethylamine (47.0 g, 464 mmol) was added, and the reaction mixture was stirred at 25-30° C. for five hours. TLC indicated incomplete conversion, and more EDC (29.5 g, 154 mmol) was added. Having stirred overnight at ambient temperature, a clear solution was observed, and TLC now indicated full conversion. The reaction mixture was mixed with DCM (2.3 L) and 2% sodium bicarbonate (7 L). The organic phase was washed twice with 1.25% sodium chloride (5 L each) and dried with anhydrous magnesium sulphate (186 g). The filtrate was evaporated at 50° C. and 30 mBar to give 253 g of crude oil. The crude material was loaded to a column packed with 2.6 kg of silica gel 60 (40-630 The product was eluted with toluene:ethyl acetate (8:2) (4 L), and followed with ethyl acetate:methanol (1:1) (5 L). The product containing fractions (3.5-8 L) was evaporated (50° C./250-20 mBar) to give 208 g (66%) of 2,2'-(2-(dimethylamino)acetylazanediyl)bis(ethane-2,1-diyl) ditetradecanoate (HEDC-DiMeGly-IN) as an oil.

Figure 9D:
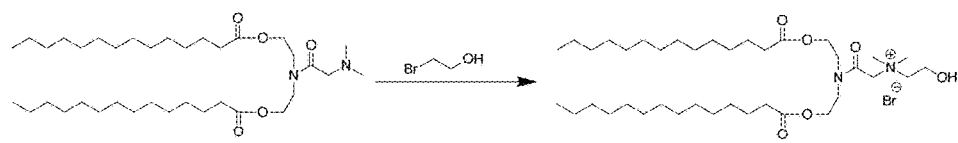
FIG. 9D shows preparation of HEDC.

Preparation of HEDC: 2-(bis(2-(tetradecanoyloxy)ethyl)amino)-N-(2-hydroxyethyl)-N,N-dimethyl-2-oxethan-aminium bromide (FIG. 9D). A mixture of HEDC-DiMeGly-IN (206 g, 337 mmol) and 2-bromoethanol (274 g, 2.19 mol) was stirred at 80° C. for two hours. HPLC indicated 8.1% of unreacted dimethylglycin-intermediate. After another 40 minutes at 80° C., HPLC indicated 7.8% of unreacted dimethylglycin intermediate. Ethyl acetate (2 L) at 65° C. was added. A blank filtration of the hot solution was washed with hot ethyl acetate (0.5 L). The combined filtrates were cooled to 0° C., and crystallization was initiated by seeding. The product suspension was cooled slowly and stirred at −16 to −18° C. for 40 minutes. The precipitate was isolated by filtration, and the filter cake was washed with cold ethyl acetate (200 mL). Drying overnight (20° C./<1 mBar) gave 211 g of crude material. The material was recrystallized from a mixture of ethyl acetate (2.1 L) and ethanol (105 mL) by heating to 35° C. and seeding at 25° C. The precipitate was isolated at 10° C., washed with cold ethyl acetate (300 mL) and dried (20° C./<1 mBar) overnight to give 161 g (66%) of 2-(bis(2-(tetradecanoyloxy)ethyl)amino)-N-(2-hydroxyethyl)-N,N-dimethyl-2-oxoethan-aminium bromide (HEDC). HPLC indicated 99.5% purity. QTOF MS ESI+: m/z 655.6 (M+H).

Example 25: Preparation of 2-(bis(3-(tetradecanoyloxy)propyl)amino)-N-(2-hydroxyethyl)-N,N-dimethyl-2-oxo-ethanaminium bromide (Pr-HEDC) (FIGS. 10A-10F)

Figure 10A:
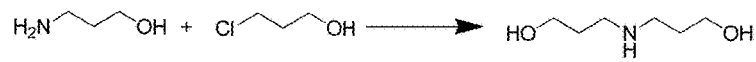
FIG. 10A shows preparation of 3,3'-azanediylbis(propan-1-ol).
Figure 10B:
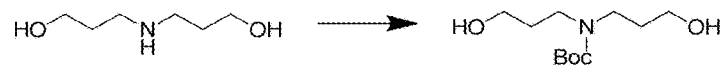
FIG. 10B shows preparation of tert-butyl bis(3-hydroxypropyl)carbamate.
Figure 10C:
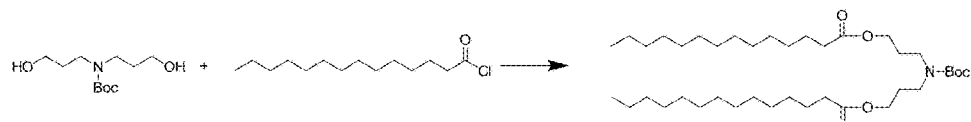
FIG. 10C shows preparation of ((tert-butoxycarbonyl) azanediyl)bis(propane-3,1-diyl) ditetradecanoate.

Preparation of 3,3'-azanediylbis(propan-1-ol) (FIG. 10A). A mixture of 3-amino-1-propanol (14.5 mL, 19.0 mmol), 1-chloro-3-hydroxy propane (8 mL, 95.6 mmol) and water (~50 mL) was refluxed over 24 hours. Potassium hydroxide (5.40 g) was then added. After dissolution, the whole of the water was evaporated to leave viscous oil and large quantities of potassium chloride. These were filtered and washed with dry acetone and dichloromethane. The organic phase was dried over Na$_2$SO$_4$, filtered, and concentrated. Product was then purified via silica gel chromatography with a DCM/MeOH gradient to yield 12.5 g 3,3'-azanediylbis(propan-1-ol).

Preparation of tert-butyl bis(3-hydroxypropyl)carbamate (FIG. 10B). 3,3'-Azanediylbis(propan-1-ol) (12.5 g, 95.4 mmol) was diluted in DCM (25 mL). A solution of di-tert-butyl dicarbonate (26 g, 119.25 mmol) in DCM (25 mL) was slowly added while stirring under a blanket of argon gas. The reaction was stirred overnight. The reaction mixture was concentrated. Purification by silica gel chromatography with a DCM/MeOH gradient yielded tert-butyl bis(3-hydroxypropyl)carbamate.

Preparation of ((tert-butoxycarbonyl)azanediyl)bis(propane-3,1-diyl) ditetradecanoate (FIG. 10C). tert-Butyl bis(3-hydroxypropyl)carbamate (4.00 g, 17.3 mmol), triethylamine (4.80 ml, 34.6 mmol) and 4-dimethylaminopyridine (529 mg, 4.33 mmol) were dissolved in chloroform (50 mL). While being stirred in an ice-bath, a solution of myristoyl chloride was added in ~15 min. The addition was carried out in such a way that the temperature of the reaction did not exceed 30° C. The reaction was stirred at room temperature overnight. MeOH (50 mL) and 0.9% saline solution (50 mL) was added to quench the reaction. The organic layer was separated and washed with 1M NaHCO$_3$. Solvent was dried with Na$_2$SO$_4$, filtered, and concentrated in vacuo to yield ((tert-butoxycarbonyl)azanediyl)bis(propane-3,1-diyl) ditetradecanoate as an oil.

Figure 10D:
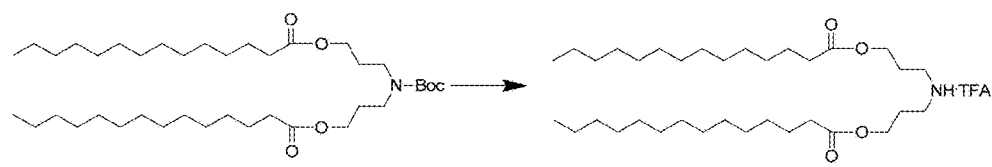
FIG. 10D shows preparation of azanediylbis(propane-3, 1-diyl) ditetradecanoate TFA salt.

Preparation of azanediylbis(propane-3,1-diyl) ditetradecanoate TFA salt (FIG. 10D). ((tert-butoxycarbonyl)azanediyl)bis(propane-3,1-diyl) ditetradecanoate (11.3 g, 17.3 mmol) was dissolved in TFA/CHCl$_3$ (1:1, 20 mL) and the mixture was stirred at room temperature for 15 minutes. The mixture was then concentrated in vacuo. The residue was then dissolved in DCM and washed with water, dried with Na$_2$SO$_4$, and concentrated in vacuo. Purification by silica gel chromatography with a DCM/MeOH gradient yielded azanediylbis(propane-3,1-diyl) ditetradecanoate TFA salt (750 mg).

Figure 10E:
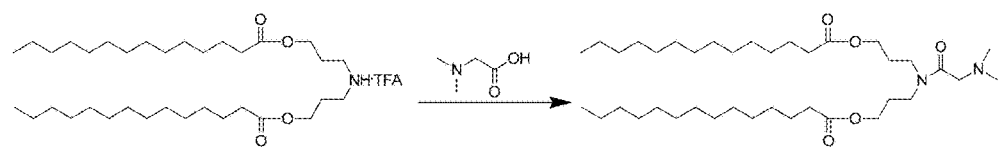
FIG. 10E shows preparation of ((2-(dimethylamino) acetyl)azanediyl)bis(propane-3,1-diyl) ditetradecanoate.

Preparation of ((2-(dimethylamino)acetyl)azanediyl)bis(propane-3,1-diyl) ditetradecanoate (FIG. 10E). Azanediylbis(propane-3,1-diyl) ditetradecanoate TFA salt (750 mg, 1.35 mmol) was diluted with DCM (5 mL) and added to a pre-activated mixture of N,N-dimethylglycine (154 mg, 1.49 mmol), HATU (616 mg, 1.62 mmol) and N,N-diisopropylethylamine (DIEA) (495 µL, 2.84 mmol) in DCM (5 mL). Product was flushed with argon and stirred at room temperature overnight, and then concentrated. Purification by silica gel chromatography with a DCM/MeOH gradient yielded 465 mg ((2-(dimethylamino)acetyl)azanediyl)bis(propane-3,1-diyl)ditetradecanoate.

Figure 10F:
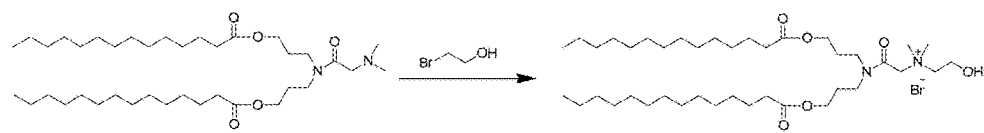
FIG. 10F shows preparation of Pr-HEDC.

Preparation of Pr-HEDC: 2-(bis(3-(tetradecanoyloxy)propyl)amino)-N-(2-hydroxyethyl)-N,N-dimethyl-2-oxoethanaminium bromide (FIG. 10F). In a sealed system, ((2-(dimethylamino)acetyl)azanediyl)bis(propane-3,1-diyl) ditetradecanoate (246 mg, 0.385 mmol) was dissolved in acetonitrile (ACN) (10 mL), and 2-bromoethanol (500 µL) was added. The reaction vessel was flushed with inert gas and then sealed. The mixture was heated to 80° C., stirred overnight, and then cooled and concentrated in vacuo. Purification by silica gel chromatography with a DCM/MeOH gradient yielded 99 mg 2-(bis(3-(tetradecanoyloxy)propyl)amino)-N-(2-hydroxyethyl)-N,N-dimethyl-2-oxoethanaminium bromide. QTOF MS ESI+: m/z 683.6 (M+H).

Example 26: Preparation of 2-(bis(3-(oleoyloxy)propyl)amino)-N-(2-hydroxyethyl)-N,N-dimethyl-2-oxoethanaminium bromide (Pr-HE-DODC) (FIGS. 11A-11D)

Preparation of (Z)-((tert-butoxycarbonyl)azanediyl)bis(propane-3,1-diyl) dioleate (FIG. 11A). tert-Butyl bis(3-hydroxypropyl)carbamate (synthesized as described above), triethylamine and N,N-4-dimethylaminopyridine (DMAP) were dissolved in chloroform. While stirring in an ice-bath, a solution of oleoyl chloride was added in 15 minutes. The temperature of the reaction during addition did not exceed 30° C. The reaction was stirred at room temperature overnight. MeOH (50 mL) and 0.9% saline solution (50 mL) were added to quench the reaction. The organic layer was separated and washed with 1 M NaHCO$_3$. Solvent was dried with Na$_2$SO$_4$, filtered and concentrated to yield an oil. The product (Z)-((tert-butoxycarbonyl)azanediyl)bis(propane-3,1-diyl) dioleate was used without further purification.

Figure 11A:
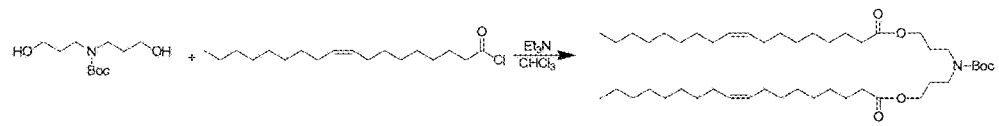
FIG. 11A shows preparation of (Z)-((tert-butoxycarbonyl) azanediyl)bis(propane-3,1-diyl) dioleate.
Figure 11B:
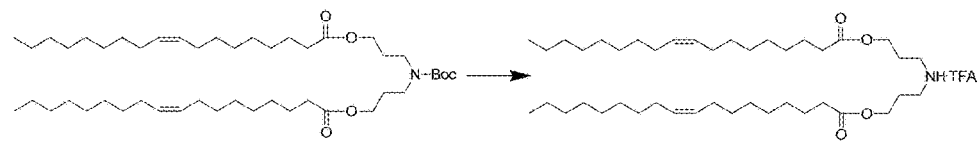
FIG. 11B shows preparation of (Z)-azanediylbis(propane-3,1-diyl) dioleate TFA salt.

Preparation of (Z)-azanediylbis(propane-3,1-diyl) dioleate TFA salt (FIG. 11B). (Z)-((tert-Butoxycarbonyl)azanediyl)bis(propane-3,1-diyl) dioleate (13.2 g, 17.3 mmol) was dissolved in TFA/CHCl$_3$ (1:1, 20 mL) and the mixture was stirred at room temperature for 15 minutes. The mixture was then concentrated in vacuo. The residue was dissolved in DCM and washed with water, dried with Na$_2$SO$_4$ and concentrated. Purification by silica gel chromatography with a DCM/MeOH gradient yielded (Z)-azanediylbis(propane-3,1-diyl) dioleate TFA salt (750 mg).

Figure 11C:
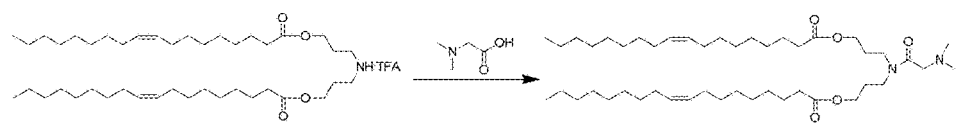
FIG. 11C shows preparation of (Z)-((2-(dimethylamino) acetyl)azanediyl)bis(propane-3,1-diyl) dioleate.

Preparation of (Z)-((2-(dimethylamino)acetyl)azanediyl)bis(propane-3,1-diyl) dioleate (FIG. 11C). (Z)-azanediylbis(propane-3,1-diyl) dioleate TFA salt (750 mg, 1.13 mmol) was diluted with DCM (5 mL) and added to a pre-activated mixture of N,N-dimethylglycine (128 mg, 1.24 mmol), 1-[bis(dimethylamino)methylene]-1H-1,2,3-triazolo[4,5-b]pyridinium 3-oxid hexafluorophosphate, (HATU) (517 mg, 1.36 mmol) and N,N-diisopropylethylamine (DIEA) (413 µL, 2.37 mmol) in DCM (5 mL). The mixture was flushed with argon and stirred at room temperature overnight. The reaction mixture was concentrated, and subjected to silica gel chromatography with a DCM/MeOH gradient to yield (Z)-((2-(dimethylamino)acetyl)azanediyl)bis(propane-3,1-diyl) dioleate.

Figure 11D:
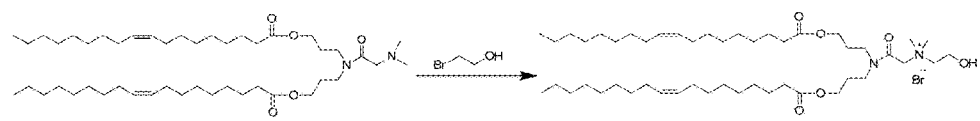
FIG. 11D shows preparation of Pr-HE-DODC.

Preparation of Pr-HE-DODC: 2-(bis(3-(oleoyloxy)propyl)amino)-N-(2-hydroxyethyl)-N,N-dimethyl-2-oxoethanaminium bromide (FIG. 11D). In a sealed system, (Z)-((2-(dimethylamino)acetyl)azanediyl)bis(propane-3,1-diyl) dioleate (269 mg, 0.360 mmol) was dissolved in ACN (10 mL) and 2-bromoethanol (200 uL) was added. The reaction vessel was flushed with inert gas and then sealed. Reaction was heated to 80° C. and stirred overnight. The reaction mixture was cooled and concentrated. Purification by silica gel chromatography with a DCM/MeOH gradient yielded 2-(bis(3-(oleoyloxy)propyl)amino)-N-(2-hydroxyethyl)-N,N-dimethyl-2-oxoethanaminium bromide (129 mg). QTOF MS ESI+: m/z 791.7 (M+H).

Example 27: Preparation of 3-(bis(2-(tetradecanoyloxy)ethyl)amino)-N-(2-hydroxyethyl)-N,N-dimethyl-3-oxopro-pan-1-aminium bromide (HE-Et-DC) (FIGS. 12A-12B)

Figure 12A:
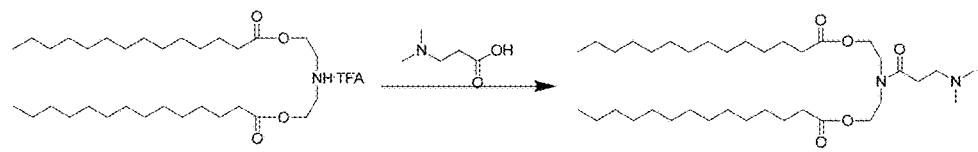
FIG. 12A shows preparation of ((3-(dimethylamino)propanoyl)azanediyl)bis(ethane-2,1-diyl) ditetradecanoate.

Preparation of ((3-(dimethylamino)propanoyl)azanediyl)bis(ethane-2,1-diyl) ditetradecanoate (FIG. 12A). Synthesis of azanediylbis(ethane-2,1-diyl) ditetradecanoate TFA salt previously described. Azanediylbis(ethane-2,1-diyl) ditetradecanoate TFA salt (1.5 g, 2.85 mmol) was diluted with DCM (10 mL) and added to a pre-activated mixture of 3-(dimethylamino)propionic acid HCl salt (482 mg, 3.14 mmol), HATU (1.30 g, 3.42 mmol) and DIEA (1.04 mL, 5.98 mmol) in DCM (10 mL). The round-bottomed flask was flushed with argon and the reaction mixture was stirred at room temperature overnight. The reaction mixture was concentrated. Purification by silica gel chromatography with a DCM/MeOH gradient yielded ((3-(dimethylamino)propanoyl)azanediyl)bis(ethane-2,1-diyl) ditetradecanoate.

Figure 12B:
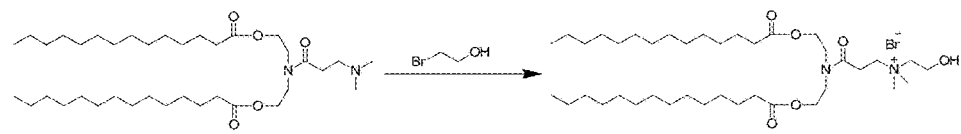
FIG. 12B shows preparation of HE-Et-DC.

Preparation of HE-Et-DC: 3-(bis(2-(tetradecanoyloxy)ethyl)amino)-N-(2-hydroxyethyl)-N,N-dimethyl-3-oxopropan-1-aminium bromide (FIG. 12B). In a sealed system, ((3-(dimethylamino)propanoyl)azanediyl)bis(ethane-2,1-diyl) ditetradecanoate (606 mg, 0.970 mmol) was dissolved in ACN (10 mL) and 2-bromoethanol (500 uL) was added. The reaction vessel was flushed with inert gas and then sealed. Reaction was heated to 80° C. and stirred overnight, then cooled and concentrated. Purification by silica gel chromatography with a DCM/MeOH gradient yielded 3-(bis (2-(tetradecanoyloxy)ethyl)amino)-N-(2-hydroxyethyl)-N, N-dimethyl-3-oxopropan-1-aminium bromide (80 mg). QTOF MS ESI+: m/z 669.6 (M+H).

Example 28: Preparation of 3-(bis(2-(oleoyloxy) ethyl)amino)-N-(2-hydroxyethyl)-N,N-dimethyl-3-oxopropan-1-aminium bromide (HE-Et-DODC) (FIGS. 12A-12D)

Figure 13A:
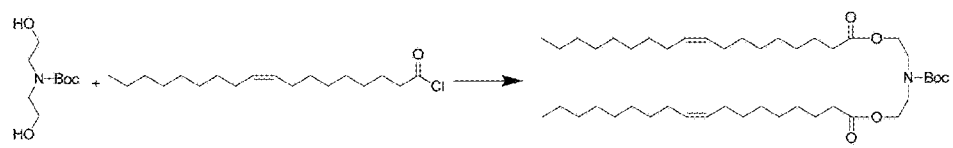
FIG. 13A shows preparation of (Z)-((tert-butoxycarbonyl) azanediyl)bis(ethane-2,1-diyl) dioleate.

Preparation of (Z)-((tert-butoxycarbonyl)azanediyl)bis (ethane-2,1-diyl) dioleate (FIG. 13A). N-tert-butoxycarbonyl (N-Boc) diethanolamine) (17.81 g, 0.087 mole), triethylamine (24.4 ml, 0.176 mole) and 4-(dimethylamino) pyridine (2.76 ml, 1.3 g, 0.023 mole) were dissolved in 350 ml of chloroform. While being stirred, a solution of oleoyl chloride (61.6 g, 0.174 mole) in 100 ml of chloroform was added in 10 minutes. (Alternatively, the chloroform solution of N-Boc diethanolamine was immersed in an ice/water bath while oleoyl chloride was added.) The temperature of the reaction mixture did not exceed 50° C. during the addition. The reaction mixture was stirred at room temperature for 2 hours. A mixture of 200 ml of methanol and 200 ml of 0.9% saline was added to quench the reaction. The organic layer was separated and was washed with 2×100 ml of dilute aqueous sodium bicarbonate. The solvent was removed to afford 59.5 g of crude product as pale yellow oil (59.5 g, 0.081 mole, 100% yield). This material was used for the next step without further purification. 1H NMR (400 MHz, CDCl3) 0.87 (t, 6H, CH3), 1.20-1.40 (m, 40H, CH2), 1.45 (s, 9H, tBu CH3), 1.59 (m, 4H, CH2CH2C(=O)), 2.00 (m, 8H, CH2CH=CH), 2.33 (t, 4H, CH2C(=O)), 3.48 (m, 4H, NCH2CH2O), 4.18 (m, 4H, NCH2CH2O), 5.33 (m, 4H, CH=CH).

Figure 13B:
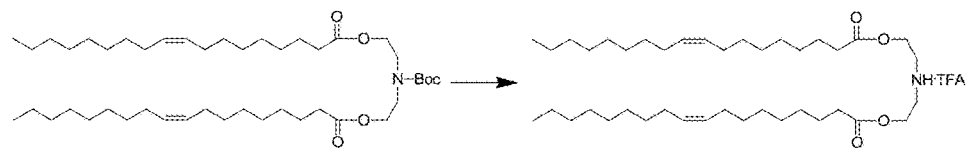
FIG. 13B shows preparation of (Z)-azanediylbis(ethane-2,1-diyl) dioleate TFA salt.

Preparation of (Z)-azanediylbis(ethane-2,1-diyl) dioleate TFA salt (FIG. 13B). The (Z)-((tert-butoxycarbonyl) azanediyl)bis(ethane-2,1-diyl) dioleate (59.5 g, 0.081 mole) was treated twice with 100 ml trifluoroacetic acid (100 ml, 1.35 mole) and 100 ml of chloroform. Each consisted of stirring at room temperature for ten minutes, and the solvent was removed by rotary evaporation at the end of each treatment. After the second treatment, the reaction mixture was concentrated by rotary evaporation. The residue was dissolved in 200 ml of methylene chloride and the mixture had been washed with 100 ml of water twice. The residue was purified by silica gel chromatography using a mixture of methanol and methylene chloride as eluent to yield 44 g of (Z)-azanediylbis(ethane-2,1-diyl) dioleate TFA salt (44.0 g). 1H NMR (400 MHz, CDCl3) 0.87 (t, 6H, CH3), 1.20-1.40 (m, 40H, CH2), 1.59 (m, 4H, CH2CH2C(=O)), 2.00 (m, 8H, CH2CH=CH), 2.33 (t, 4H, CH2C(=O)), 3.31 (m, 4H, NCH2CH2O), 4.38 (m, 4H, NCH2CH2O), 5.33 (m, 4H, CH=CH).

Figure 13C:
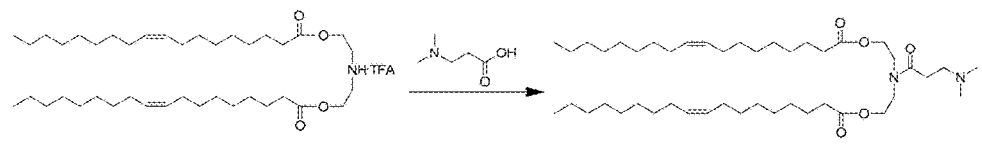
FIG. 13C shows preparation of (((Z)-((3-(dimethylamino) propanoyl)azanediyl)bis(ethane-2,1-diyl) dioleate.

Preparation of (((Z)-((3-(dimethylamino)propanoyl) azanediyl)bis(ethane-2,1-diyl) dioleate (FIG. 13C). (Z)-azanediylbis(ethane-2,1-diyl) dioleate TFA salt (1.50 g, 2.37 mmol) was diluted with DCM (10 mL) and added to a pre-activated mixture of 3-(dimethylamino)propionic acid HCl salt (383 mg, 2.49 mmol), HATU (1034 mg, 2.72 mmol) and DIEA (831 μL, 4.77 mmol) in DCM (10 mL). The reaction mixture was flushed with argon and stirred at room temperature overnight. The reaction mixture was concentrated. Purification by silica gel chromatography with a DCM/MeOH gradient yielded (Z)-((3-(dimethylamino)propanoyl)azanediyl)bis(ethane-2,1-diyl) dioleate.

Figure 13D:
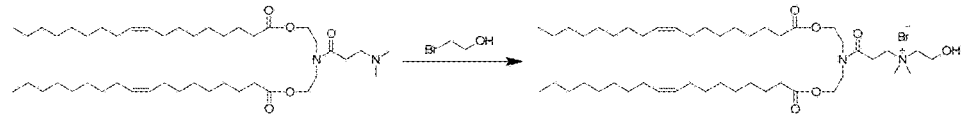
FIG. 13D shows preparation of HE-Et-DODC.

Preparation of HE-Et-DODC: 3-(bis(2-(oleoyloxy)ethyl) amino)-N-(2-hydroxyethyl)-N,N-dimethyl-3-oxo-propan-1-aminium bromide (FIG. 13D). In a sealed system, (((Z)-((3-(dimethylamino)propanoyl)azanediyl)bis(ethane-2,1-diyl) dioleate (588 mg, 0.802 mmol) was dissolved in ACN (10 mL) and 2-bromoethanol (200 uL) was added. The reaction vessel was flushed with inert gas and then sealed. Reaction was heated to 80° C. and stirred overnight, then cooled and concentrated in vacuo. Purification by silica gel chromatography with a DCM/MeOH gradient yielded 3-(bis(2-(oleoyloxy)ethyl)amino)-N-(2-hydroxyethyl)-N,N-dimethyl-3-oxopropan-1-aminium bromide (160 mg). QTOF MS ESI+: m/z 764.3 (M+H).

Example 29: Preparation of 4-(bis(2-(tetradecanoyloxy)ethyl)amino)-N-(2-hydroxyethyl)-N,N-dimethyl-4-oxobutan-1-aminium bromide (HE-Pr-DC) (FIGS. 14A-14B)

Figure 14A:
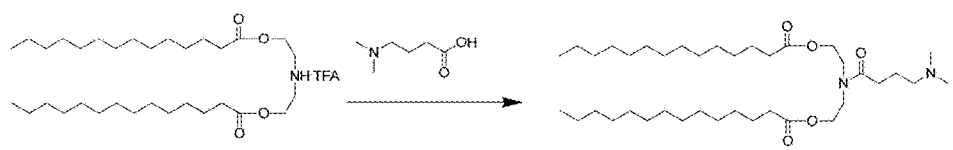
FIG. 14A shows preparation of ((4-(dimethylamino)butanoyl)azanediyl)bis(ethane-2,1-diyl) ditetradecanoate.

Preparation of ((4-(dimethylamino)butanoyl)azanediyl) bis(ethane-2,1-diyl) ditetradecanoate (FIG. 14A). Synthesis of azanediylbis(ethane-2,1-diyl) ditetradecanoate TFA salt previously described. Azanediylbis(ethane-2,1-diyl) ditetradecanoate TFA salt (1.00 g, 1.90 mmol) was diluted with DCM (5 mL) and added to a pre-activated mixture of 4-(dimethylamino) butyric acid HCl salt (382 mg, 2.28 mmol), HATU (867 mg, 2.28 mmol) and DIEA (728 μL, 4.18 mmol) in DCM (5 mL). The flask was flushed with argon and the reaction mixture was stirred at room temperature overnight, then concentrated. Purification by silica gel chromatography with a DCM/MeOH gradient yielded ((4-(dimethylamino)butanoyl)azanediyl)bis(ethane-2,1-diyl) ditetradecanoate.

Figure 14B:
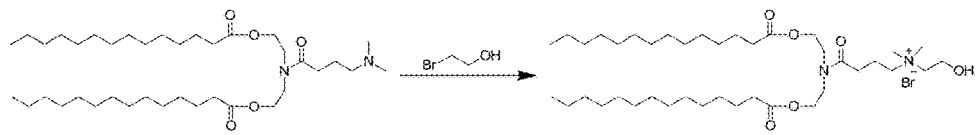
FIG. 14B shows preparation of HE-Pr-DC.

Preparation of HE-Pr-DC: 4-(bis(2-(tetradecanoyloxy) ethyl)amino)-N-(2-hydroxyethyl)-N,N-dimethyl-4-oxobutan-1-aminium bromide (FIG. 14B). In a sealed system, ((4-(dimethylamino)butanoyl)azanediyl)bis(ethane-2,1-diyl) ditetradecanoate (300 mg, 0.469 mmol) was dissolved in ACN (5 mL) and 2-bromoethanol (500 μL) was added. The reaction vessel was flushed with inert gas and then sealed. Reaction was heated to 80° C. and stirred overnight, then concentrated. Purification by silica gel chromatography with a DCM/MeOH gradient yielded 4-(bis(2-(tetradecanoyloxy)ethyl)amino)-N-(2-hydroxyethyl)-N,N-dimethyl-4-oxobutan-1-aminium bromide (140 mg). LCMS ESI+: m/z 684.4 (M+H).

Example 30: Preparation of 4-(bis(2-(oleoyloxy) ethyl)amino)-N-(2-hydroxyethyl)-N,N-dimethyl-4-oxobutan-1-aminium bromide (HE-Pr-DODC) (FIGS. 15A-15B)

Figure 15A:
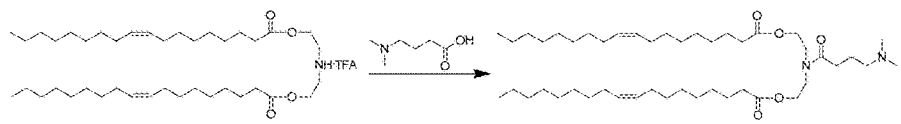
FIG. 15A shows preparation of (Z)-((4-(dimethylamino) butanoyl)azanediyl)bis(ethane-2,1-diyl) dioleate.

Preparation of (Z)-((4-(dimethylamino)butanoyl) azanediyl)bis(ethane-2,1-diyl) dioleate (FIG. 15A). Synthesis of (Z)-azanediylbis(ethane-2,1-diyl) dioleate TFA salt described above (1.00 g, 1.58 mmol) was diluted with DCM (5 mL) and added to a pre-activated mixture of 4-(dimethylamino) butyric acid HCl salt (317 mg, 1.89 mmol), HATU (719 mg, 1.89 mmol) and DIEA (606 μL, 3.48 mmol) in DCM (5 mL). The flask was flushed with argon and the reaction mixture stirred at room temperature overnight, then concentrated. Purification by silica gel chromatography with a DCM/MeOH gradient yielded (Z)-((4-(dimethylamino) butanoyl)azanediyl)bis(ethane-2,1-diyl) dioleate.

Figure 15B:
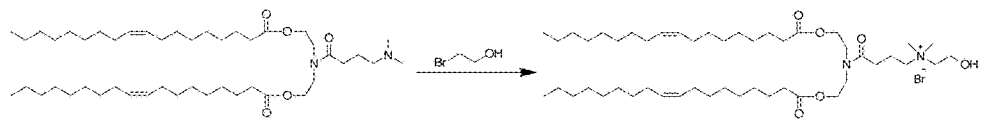
FIG. 15B shows preparation of HE-Pr-DODC.

Preparation of HE-Pr-DODC: 4-(bis(2-(oleoyloxy)ethyl)amino)-N-(2-hydroxyethyl)-N,N-dimethyl-4-oxobutan-1-aminium bromide (FIG. 15B). In a sealed system, ((4-(dimethylamino)butanoyl)azanediyl)bis(ethane-2,1-diyl) ditetradecanoate (400 mg, 0.535 mmol) was dissolved in ACN (5 mL) and 2-bromoethanol (500 μL) was added. The reaction vessel was flushed with inert gas and then sealed. Reaction was heated to 80° C. and stirred overnight, then concentrated. Purification by silica gel chromatography with DCM/MeOH gradient yielded 4-(bis(2-(oleoyloxy)ethyl)amino)-N-(2-hydroxyethyl)-N,N-dimethyl-4-oxobutan-1-aminium bromide (255 mg). LCMS ESI+: m/z 792.5 (M+H).

Example 31: Preparation of 2-(bis(2-(oleoyloxy)ethyl)amino)-N,N-bis(2-hydroxyethyl)-N-methyl-2-oxoethanaminium bromide (HE2DODC) (FIGS. 16A-16B)

Figure 16A:
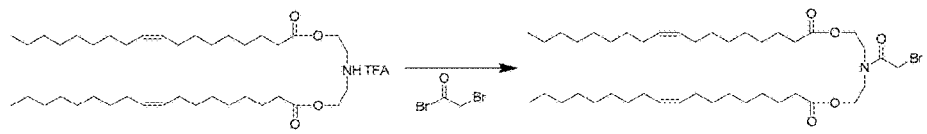
FIG. 16A shows preparation of (Z)-((2-bromoacetyl) azanediyl)bis(ethane-2,1-diyl) dioleate.

Preparation of (Z)-((2-bromoacetyl)azanediyl)bis(ethane-2,1-diyl) dioleate (FIG. 16A). Synthesis of (Z)-azanediylbis(ethane-2,1-diyl) dioleate TFA salt previously described. (Z)-azanediylbis(ethane-2,1-diyl) dioleate TFA salt (1.50 g, 2.34 mmol) was dissolved in DCM (20 mL) and placed in an ice-bath. Bromoacetyl bromide (214 μL, 2.46 mmol) was added followed by triethylamine (685 μL, 4.91 mmol). The ice-bath was removed and the reaction was stirred overnight at room temperature under inert gas, then diluted with DCM to 100 mL, and washed with a 1M HCl (75 mL), H₂O (75 mL), saturated NaHCO₃ solution (75 mL) and saturated brine solution (75 mL). All aqueous washes were back extracted with DCM (25 mL). Dried organics with MgSO₄, filtered and concentrated in vacuo. Purification by silica gel chromatography with ethyl acetate yielded (Z)-((2-bromoacetyl)azanediyl)bis(ethane-2,1-diyl) dioleate (1.22 g).

Figure 16B:
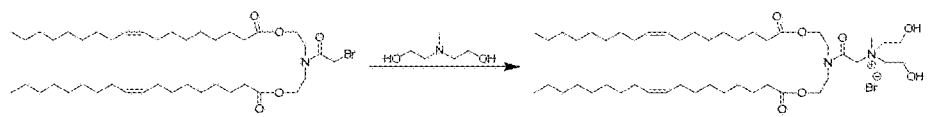
FIG. 16B shows preparation of HE2DODC.

Preparation of HE2DODC: 2-(bis(2-(oleoyloxy)ethyl)amino)-N,N-bis(2-hydroxyethyl)-N-methyl-2-oxoethanaminium bromide (FIG. 16B). In a sealed system, (Z)-((2-bromoacetyl)azanediyl)bis(ethane-2,1-diyl) dioleate (2.08 g, 2.75 mmol) was combined with N-methyldiethylamine (1.58 mL, 13.8 mmol) was added. The reaction vessel was flushed with inert gas and then sealed. Reaction was heated to 50° C. and stirred overnight, and then concentrated. Purification by silica gel chromatography with DCM/MeOH gradient yielded 2-(bis(2-(oleoyloxy)ethyl)amino)-N,N-bis(2-hydroxyethyl)-N-methyl-2-oxoethanaminium bromide (479 mg). LCMS ESI+: m/z 793.7 (M+H).

Figure 17:
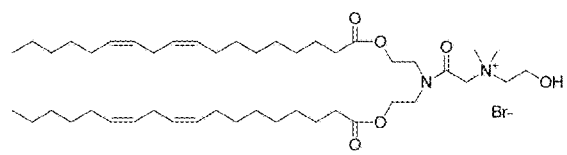
FIG. 17 shows the structure of HEDC-DLin.

Example 32: Preparation of 2-(bis(2-((9Z,12Z)-octadeca-9,12-dienoyloxy)ethyl)amino)-N-(2-hydroxyethyl)-N,N-dimethyl-2-oxoethanaminium bromide (HEDC-DLin) (FIG. 17)

2-(bis(2-((9Z,12Z)-octadeca-9,12-dienoyloxy)ethyl)amino)-N-(2-hydroxyethyl)-N,N-dimethyl-2-oxoethanaminium bromide was prepared as described above for HEDC with the substitution of (9Z,12Z)-octadeca-9,12-dienoyl chloride for myristoyl chloride.

Example 33: Preparation of 2-(bis(2-(dodecanoyloxy)ethyl)amino)-N-(2-hydroxyethyl)-N,N-dimethyl-2-oxoethanaminium bromide (HEDC-12)

2-(bis(2-(Dodecanoyloxy)ethyl)amino)-N-(2-hydroxyethyl)-N,N-dimethyl-2-oxoethanaminium bromide was prepared as described above for HEDC with the substitution of dodecanoyl chloride for myristoyl chloride.

Example 34: Preparation of 2-((2-(bis(2-(tetradecanoyloxy)ethyl)amino)-2-oxoethyl)thio)-N-(2-hydroxyethyl)-N,N-dimethylethanaminium bromide (HES104) (FIGS. 18A-18B)

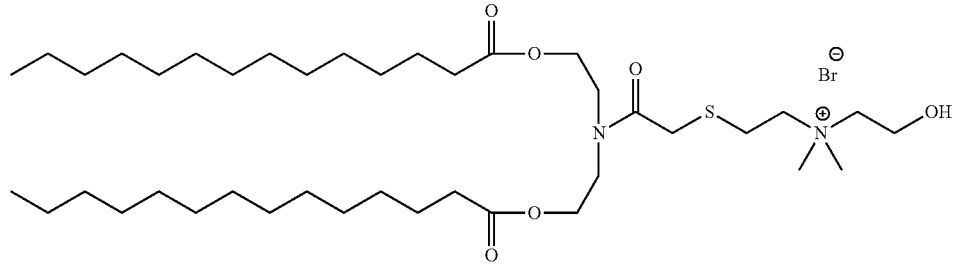 [SMILES: CCCCCCCCCCCCCC(=O)OCCN(CCOC(=O)CCCCCCCCCCCCC)C(=O)CSCC[N+](C)(C)CCO ; [Br-]]

Figure 18A:
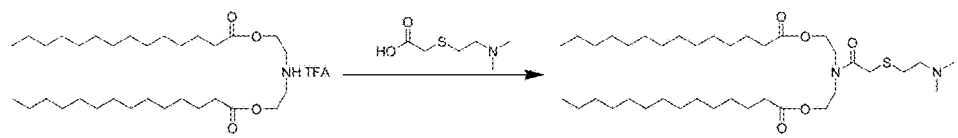
FIG. 18A shows preparation of S104.
Figure 18B:
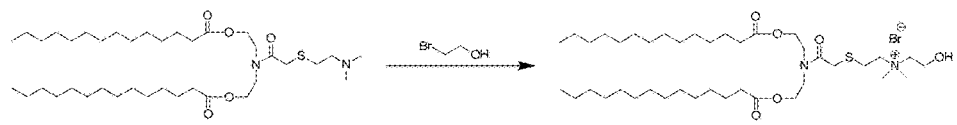
FIG. 18B shows preparation of HES104.

Preparation of ((2-((2-(dimethylamino)ethyl)thio)acetyl)azanediyl)bis(ethane-2,1-diyl) ditetradecanoate (S104) (FIG. 18A).

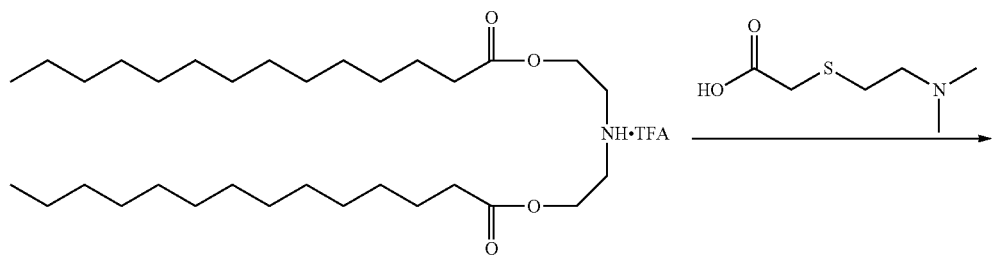

-continued

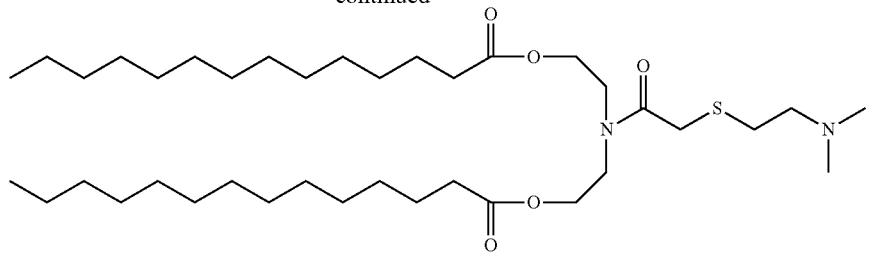

Synthesis of azanediylbis(ethane-2,1-diyl) ditetradecanoate TFA salt as described above (152 g, 238 mmol) was stirred with DCM (2.3 L) and 10% potassium bicarbonate (1.15 L) at 0-5° C. The organic phase was separated and the aqueous phase is further extracted with DCM (1.15 L). The combined organic phases were stirred with magnesium sulphate hydrate (236 g) for 30 minutes at 0-5° C., filtrated and washed with DCM (1.15 L). To the combined filtrates were added 2-((2-(dimethylamino)ethyl)thio)acetic acid hydrochloride (57.0 g, 285 mmol), EDC (68.4 g, 357 mmol) and DMAP (2.91 g, 23.8 mmol), and the suspension was stirred overnight at ambient temperature, after which period of time a clear solution was formed. Water (2.3 L) and methanol (460 mL) were added and after having stirred for 10 minutes the clear organic phase was separated. The turbid aqueous phase (pH 3.0) was extracted with DCM (575 mL). The combined organic extracts were concentrated yielding 143 g of crude material as the hydrochloride salt. The crude material (142.6 g) was transferred to a distillation flask with DCM (500 mL), and ethyl acetate (1 L) was added. The solution was heated to distillation at atmospheric pressure, and distillation was continued for 70 minutes to obtain a temperature of the residue of 76° C. A total volume of 1.4 L was obtained by addition of ethyl acetate (800 mL), and ethanol (70 mL) was added. The clear solution at 50° C. was cooled to 37° C. and seed crystals were added. Having observed initiation of significant crystallization for 10 minutes at 37-35° C., the suspension was cooled and stirred at 0° C. overnight and the precipitate was isolated by filtration, and washed with cold ethyl acetate (210 mL). Drying to a constant weight at ambient temperature in oil pump vacuum for 4.5 hours gave 134 g of recrystallized material as the hydrochloride salt, white crystalline solid. Tripotassium phosphate (85 g, 0.40 mol) and dipotassium hydrogen phosphate (226 g, 1.30 mol) was added to purified water (1.7 L), and the solution formed with pH 10.9 was cooled to 18-20° C. DCM (1.3 L) and recrystallized S104 hydrochloride (133 g, 0.188 mol) were added, and the mixture was stirred for 10 minutes. A clear organic phase was separated at moderate rate (over 35 minutes), and the turbid aqueous phase was further extracted with DCM (650 mL). The combined organic phases were stirred with anhydrous magnesium sulfate (65 g) for 40 min, and the mixture was filtered, washing with DCM (200 mL). The combined filtrates were evaporated from a 50° C. water bath under reduced pressure (down to 20 mBar, at which pressure evaporation was continued for one hour). Additional evaporation from a 15-20° C. water bath at oil pump vacuum, resulted in 126 g partially solidified oil. Cooling in −20° C. cooling bath gave complete solidification, and after drying at −20° C. under an oil pump vacuum, we have obtained 126 g of ((2-((2-(dimethylamino)ethyl)thio)acetyl)azanediyl)bis(ethane-2,1-diyl) ditetradecanoate (S104). HPLC indicated 98.1% purity.

Preparation of HES104: 2-((2-(bis(2-(tetradecanoyloxy)ethyl)amino)-2-oxoethyl)thio)-N-(2-hydroxyethyl)-N,N-dimethylethanaminium bromide (FIG. 18B)

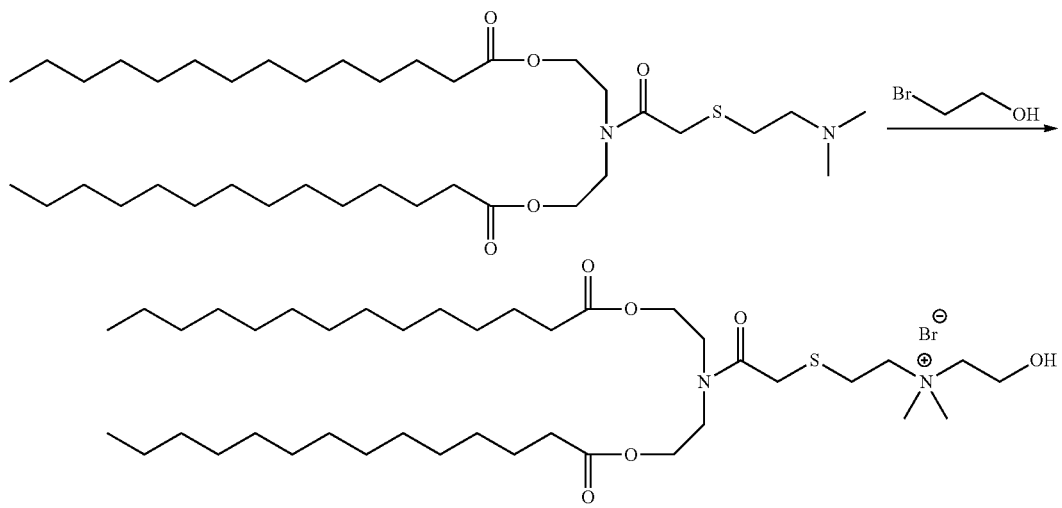

In a sealed system, ((2-((2-(dimethylamino)ethyl)thio)acetyl)azanediyl)bis(ethane-2,1-diyl) ditetradecanoate (1.00 g, 1.49 mmol) was combined with 2-bromoethanol (687 µL, 9.69 mmol) was added. The reaction vessel was flushed with inert gas and then sealed. Reaction was heated to 75° C. and stirred overnight, then cooled, and concentrated in vacuo. Purification by silica gel chromatography with DCM/MeOH gradient yielded 2-((2-(bis(2-(tetradecanoyloxy)ethyl)amino)-2-oxoethyl)thio)-N-(2-hydroxyethyl)-N,N-dimethylethanaminium bromide (HES104) (790 mg). LCMS ESI+: m/z 715.7 (M+H).

Example 35: Preparation of 2-((2-(bis(2-(oleoyloxy)ethyl)amino)-2-oxoethyl)thio)-N-(2-hydroxyethyl)-N,N-dimethylethanaminium bromide (HES104-DO) (FIGS. 19A-19B)

Figure 19A:
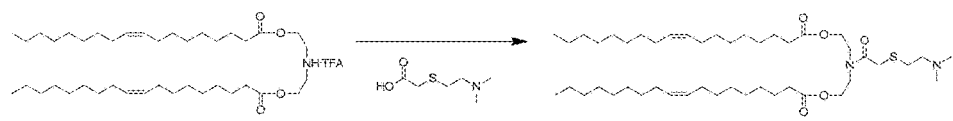
FIG. 19A shows preparation of (Z)-((2-((2-(dimethylamino)ethyl)thio)acetyl)azanediyl)bis(ethane-2,1-diyl) dioleate.

Preparation of (Z)-((2-((2-(dimethylamino)ethyl)thio)acetyl)azanediyl)bis(ethane-2,1-diyl) dioleate (FIG. 19A). Synthesis of (Z)-azanediylbis(ethane-2,1-diyl) dioleate TFA salt previously described. (Z)-azanediylbis(ethane-2,1-diyl) dioleate TFA salt (4.06 g, 6.41 mmol) was stirred in DCM (60 mL) with 10% $K_2CO_3$ (30 mL) at 0-5° C. After 30 min, the organic phase was separated and the aqueous phase was further extracted with DCM (30 mL). The combined organic phases were stirred with anhydrous $MgSO_4$ for 30 minutes at 0-5° C., filtered, and washed with DCM (30 mL). To the combined filtrates were added to 2-((2-(dimethylamino)ethyl)thio)acetic acid (1.26 g, 7.70 mmol), EDC HCl salt (1.84 g, 9.62 mmol), DMAP (78.3 mg, 0.64 mmol). The thin suspension was stirred overnight at room temperature; after which the solution became clear. Next day, deionized water (60 mL) and methanol (30 mL) were added. After stirring for 10 minutes, the clear organic layer was isolated. The turbid aqueous phase is extracted with DCM. The combined organic extracts were concentrated. Crude material was filtered through silica and taken up in DCM (40 mL) and phosphate buffered saline (PBS) (pH=11, 50 mL) was added. The mixture was stirred at room temperature for 10 min. The organic phase was separated and the aqueous phase is extracted again with DCM (15 mL). The combined organic phases were stirred with anhydrous $MgSO_4$ for 30 minutes. The mixture was then filtered, and washed with DCM. The combined filtrates were concentrated in vacuo to yield (Z)-((2-((2-(dimethylamino)ethyl)thio)acetyl)azanediyl)bis(ethane-2,1-diyl) dioleate (3.44 g).

Figure 19B:
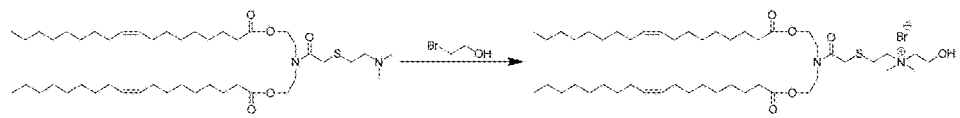
FIG. 19B shows preparation of HES104-DO.

Preparation of HES104-DO (FIG. 19B). In a sealed system, (Z)-((2-((2-(dimethylamino)ethyl)thio)acetyl)azanediyl)bis(ethane-2,1-diyl) dioleate (540 mg, 0.693 mmol) was combined with 2-bromoethanol (319 μL) was added. The reaction vessel was flushed with inert gas and then sealed. Reaction was heated to 75° C. and stirred overnight. Next day, cooled and concentrated in vacuo. Purification by silica gel chromatography with DCM/MeOH gradient yielded 2-((2-(bis(2-(oleoyloxy)ethyl)amino)-2-oxoethyl)thio)-N-(2-hydroxyethyl)-N,N-dimethylethanaminium bromide (324 mg). LCMS ESI+: m/z 823.8 (M+H).

Example 36: Preparation of 2-((bis(2-(oleoyloxy)ethyl)carbamoyl)thio)-N-(2-hydroxyethyl)-N,N-dimethylethan-aminium bromide (HETU104-DO) (FIGS. 20A-20B)

Figure 20A:
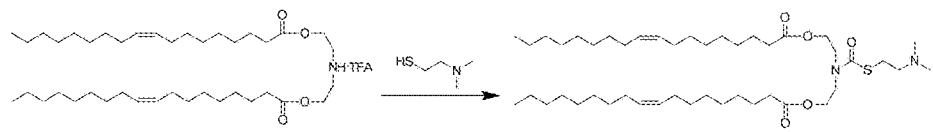
FIG. 20A shows preparation of (Z)-((((2-(dimethylamino) ethyl)thio)carbonyl)azanediyl)bis(ethane-2,1-diyl) dioleate.

Preparation of (Z)-((((2-(dimethylamino)ethyl)thio)carbonyl)azanediyl)bis(ethane-2,1-diyl) dioleate (FIG. 20A). Synthesis of (Z)-((tert-butoxycarbonyl)azanediyl)bis(ethane-2,1-diyl) dioleate previously described. (Z)-((tert-butoxycarbonyl)azanediyl)bis(ethane-2,1-diyl) dioleate (4.2 g, 5.72 mmol) was dissolved in DCM (20 mL) and cooled in an ice bath. TFA (20 mL) was added and the mixture was stirred under a blanket of inert gas for 20 minutes. Afterwards, the mixture was concentrated in vacuo. The residue was partitioned between 10% $K_2CO_3$ (20 mL) and DCM (20 mL). The mixture was stirred in an ice bath for 20 minutes. The organic portion was collected, and the turbid aqueous layer was extracted with DCM (2×10 mL). The combined organic extracts were added with anhydrous $MgSO_4$ and stirred at 0 for 20 minutes. The suspension was filtered and washed DCM (10 mL). Diphosgene (1.38 mL, 11.4 mmol) was added to (Z)-azanediylbis(ethane-2,1-diyl) dioleate material in DCM and stirred under a blanket of inert gas at room temperature. Next day, DCM and excess diphosgene was removed in vacuo. 2-(dimethylamino)ethane thiol HCl salt (4.05 g, 28.6 mmol) was taken up in DCM (50 mL) and triethylamine (5.2 mL, 37.2 mmol) and added to (Z)-((chlorocarbonyl)azanediyl)bis(ethane-2,1-diyl) dioleate residue. Reaction mixture was stirred overnight at room temperature. The mixture was diluted with DCM and washed with 0.3M HCl (75 mL), water (75 mL) and 10% $K_2CO_3$ (75 mL). The aqueous washes were back-extracted with DCM (25 mL). The organics was dried over anhydrous $MgSO_4$, filtered, and concentrated in vacuo. Purification by silica gel chromatography with DCM/MeOH gradient yielded (Z)-((((2-(dimethylamino)ethyl)thio)carbonyl)azanediyl)bis(ethane-2,1-diyl) dioleate (1.90 g).

Figure 20B:
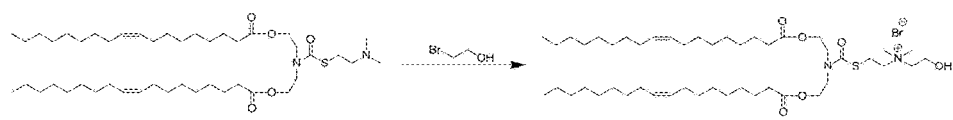
FIG. 20B shows preparation of HETU104DO.

Preparation of HETU104DO (FIG. 20B). In a sealed system, (Z)-((((2-(dimethylamino)ethyl)thio)carbonyl)azanediyl)bis(ethane-2,1-diyl) dioleate (615 mg, 0.804 mmol) was combined with 2-bromoethanol (370 μL, 5.22 mmol) was added. The reaction vessel was flushed with inert gas and then sealed. Reaction was heated to 75° C. and stirred overnight, then cooled and concentrated in vacuo. Purified by silica gel chromatography with a DCM/MeOH gradient yielded 2-((bis(2-(oleoyloxy)ethyl)carbamoyl)thio)-N-(2-hydroxyethyl)-N,N-dimethylethanaminium bromide (473 mg). LCMS ESI+: m/z 809.8 (M+H).

Example 37: Formation of Nucleic Acid-Lipid Particles

The siRNA referred to in the formulation protocols are double stranded siRNA sequence with 21-mer targeting HSP47/gp46 wherein HSP47 (mouse) and gp46 (rat) are homologs—the same gene in different species as follows: rat HSP47-C double stranded siRNA used for in vitro assay (rat pHSCs)

```
Sense (5'->3')
                                       (SEQ. ID NO. 5)
GGACAGGCCUCUACAACUAUU Antisense (3'->5')
                                       (SEQ. ID NO. 6)
TTCCUGUCCGGAGAUGUUGAU
``` mouse HSP47-C double stranded siRNA used in formulations for in vivo assay (mouse CCl4 model)

```
Sense (5'->3')
                                       (SEQ. ID NO. 3)
GGACAGGCCUGUACAACUAUU Antisense (3'->5')
                                       (SEQ. ID NO. 4)
TTCCUGUCCGGACAUGUUGAU
```

Cationic Lipid Stock Preparation.
Stock solutions of cationic lipids were prepared by combining the cationic lipid with DOPE, cholesterol, and diVA- PEG-diVA in ethanol at concentrations of 6.0, 5.1 and 2.7 and 2.4 mg/mL, respectively. If needed, solutions were warmed up to about 50° C. to facilitate the dissolution of the cationic lipids into solution.

Empty Liposome Preparation.

A cationic lipid stock solution was injected into a rapidly stirring aqueous mixture at 35-40° C. through injection needle(s) at 1.5 mL/minutes per injection port. The cationic lipid stock solution to the aqueous solution ratio (v/v) is fixed at 35:65. Upon mixing, empty vesicles formed spontaneously. The resulting vesicles were then equilibrated at 35-40° C. for 10 minutes before the ethanol content was reduced to ~12%. The empty liposomes were then diafiltered against 10× volumes of aqueous buffer to remove ethanol.

Lipoplex Preparation.

The empty vesicle prepared according to the above method was diluted to the final volume of 1 mM concentration of cationic lipid by 9% sucrose. To the stirring solution, 100 µL of 5% glucose in RNase free water was added for every mL of the diluted empty vesicle ("EV") and mixed thoroughly. 150 µL of 10 mg/mL siRNA solution in RNase free water was then added at once and mixed thoroughly. The mixture was then diluted with 5% glucose solution with 1.750 mL for every mL of the EV used. The mixture was stirred at about 200 rpm at room temperature for 10 minutes. Using a semi-permeable membrane with ~100,000 MW cut-off in a cross-flow ultrafiltration system using appropriately chosen peristaltic pump (e.g., Midgee Hoop, UFP-100-H24LA), the mixture was concentrated to about ⅓ of the original volume (or desired volume) and then diafiltered against 5 times of the sample volume using an aqueous solution containing 3% sucrose and 2.9% glucose. The product was then filtered through a combined filter of 0.8/0.2 micron pore size under aseptic conditions before use.

Formation of Non-diVA siRNA Containing Liposomes.

Cationic lipid, DOPE, cholesterol, and a PEG-conjugated lipid were solubilized in absolute ethanol at a molar ratio of 50:10:38:2. The siRNA was solubilized in 50 mM citrate buffer and the temperature was adjusted to 35-40° C. The ethanol/lipid mixture was then added to the siRNA-containing buffer while stirring to spontaneously form siRNA loaded liposomes. Lipids were combined with siRNA to reach a final total lipid to siRNA ratio of 5:1 to 15:1 (wt:wt). The siRNA loaded liposomes were diafiltered against 10× volumes of PBS (pH 7.2) to remove ethanol and exchange the buffer. Final product was passed through 0.22 µm, sterilizing grade, PES filter for bioburden reduction. This process yielded liposomes with a mean particle diameter of 50-100 nm, PDI<0.2, and >85% entrapment efficiency.

Formation of siRNA Containing Liposomes Co-Solubilized with diVA.

siRNA-diVA-Liposome formulations were prepared using the method described above. DiVA-PEG-diVA was co-solubilized in absolute ethanol with the other lipids (cationic lipid, DOPE, cholesterol, and PEG-conjugated lipids at a ratio of 50:10:38:2) prior to addition to the siRNA containing buffer. Molar content of diVA-PEG-diVA ranged from 0.1 to 5 molar ratio (i.e., 50:10:38:2:0.1 to 50:10:38:2:5). This process yielded liposomes with a mean particle diameter of 50-100 nm, PDI<0.2, and >85% entrapment efficiency.

Formation of siRNA Containing Liposomes with Cationic Lipids.

siRNA-diVA-Liposome formulations and siRNA-Liposome formulations were prepared using the method described above. Cationic lipid can be, for example, HEDC, HEDODC, DC-6-14, or any combination of these cationic lipids.

Formation of siRNA Containing Liposomes Decorated with diVA.

siRNA-Liposome formulations were prepared using the method described above and diluted to a siRNA concentration of 0.5 mg/mL in PBS. Cationic lipid can be HEDC, HEDODC, DC-6-14, or any combination of these cationic lipids. diVA-PEG-diVA was dissolved in absolute ethanol (200 proof) to a final concentration ranging from 10 to 50 mg/mL. An appropriate amount of ethanol solution was added to the siRNA-Liposome solution to yield a final molar percentage between 2 to 10 mol %. Solution was plunged up and down repeatedly with a pipette to mix. diVA-PEG-diVA concentration and ethanol addition volume were adjusted to keep the addition volume>1.0 µL and the final ethanol concentration<3% (vol/vol). Decorated liposomes were then incubated at ambient temperature for 1 hour on an orbital shaker prior to in vitro or in vivo evaluation.

The following tables set forth preferred embodiments of the description herein expressed in terms of molar ratios, as well as the equivalent mol % and weight percentages.

| Formulation | Molar Ratio | | | | |
|---|---|---|---|---|---|
| | Cationic Lipid | DOPE | Cholesterol | PEG-lipid | diVA |
| HEDODC Liposome | 50 | 10 | 38 | 2 | — |
| HEDODC Liposome + diVA | 50 | 10 | 38 | 2 | 5 |
| DC-6-14 Lipoplex | 40 | 30 | 30 | — | — |
| DC-6-14 Lipoplex + diVA | 40 | 30 | 30 | — | 5 |

| Formulation | Mol. % | | | | |
|---|---|---|---|---|---|
| | Cationic Lipid | DOPE | Cholesterol | PEG-lipid | diVA |
| HE-DODC Liposome | 50 | 10 | 38 | 2 | — |
| HE-DODC Liposome + diVA | 47.6 | 9.5 | 36.2 | 1.9 | 4.8 |
| DC-6-14 Lipoplex | 40 | 30 | 30 | — | — |
| DC-6-14 Lipoplex + diVA | 38.1 | 28.6 | 28.6 | — | 4.8 |

| Formulation | Weight Percent | | | | |
|---|---|---|---|---|---|
| | Cationic Lipid | DOPE | Cholesterol | PEG-lipid | diVA |
| HE-DODC Liposome | 61.1 | 10.8 | 21.3 | 6.9 | — |
| HE-DODC Liposome + diVA | 52.9 | 9.3 | 18.4 | 5.9 | 13.4 |
| DC-6-14 Lipoplex | 43.8 | 37 | 19.2 | — | — |
| DC-6-14 Lipoplex + diVA | 37.2 | 31.4 | 16.3 | — | 15.0 |

Example 38: Transfection with Liposomal Formulations

The transfection method is the same for LX-2 and pHSC. The liposome formulations or lipoplex formulations of the description herein were mixed with growth medium at desired concentrations. 100 µl of the mixture was added to the cells in 96-well plate and cells were incubated for 30 minutes at 37° C. in the incubator with 5% CO. After 30 min, medium was replaced with fresh growth medium. After 48 h of transfection, cells were processed using CELL-TO-CT® lysis reagents (Applied Biosystems) according to the manufacturer's instructions.

Quantitative RT-PCR for Measuring HSP47 mRNA Expression (qRT-PCR)

HSP47 and GAPDH TAQMAN® assays and One-Step RT-PCR master mix were purchased from Applied Biosystems. Each PCR reaction contained the following composition: One-step RT-PCR mix 5 µl, TAQMAN® RT enzyme mix 0.25 µl, TAQMAN® gene expression assay probe (HSP47) 0.25 µl, TAQMAN® gene expression assay probe (GAPDH) 0.5 RNase free water 3.25 Cell lysate 0.75 Total volume of 10 µl. GAPDH was used as endogenous control for the relative quantification of HSP47 mRNA levels. Quantitative RT-PCR was performed in VIIA 7® real-time PCR system (Applied Biosciences) using an in-built Relative Quantification method. All values were normalized to the average HSP47 expression of the mock transfected cells and expressed as percentage of HSP47 expression compared to mock.

In Vivo Experiments:

Female C57Bl/6 retired breeder mice (Charles River) with a weight range of 24-30 grams were used for this study. Animals were randomly distributed by weight into 10 groups of 10 animals each. All animal procedures were approved by Bio-Quant's IACUC and/or attending veterinarian as necessary and all animal welfare concerns were addressed and documented. Mice were anesthetized with Isoflurane and exsanguinated via the inferior vena cava.

Up-regulation of heat shock protein 47 (HSP47) was induced via intraperitoneal injecting $CCl_4$ in olive oil, 1:7 (vol/vol), 1 µL per gram body weight, every other day for 7 days (day 0, 2, 4, 6). On day three mice were treated for four consecutive days (day 3, 4, 5, 6) with liposome or lipoplex formulations of the description herein or PBS by IV injection into the tail vein. One group of ten mice (naïve) received neither $CCl_4$ treatment nor IV injection and served as the control group for normal HSP47 gene expression.

| Experimental Timeline | | | | | | | | |
|---|---|---|---|---|---|---|---|---|
| | Day | | | | | | | |
| | 0 | 1 | 2 | 3 | 4 | 5 | 6 | 7 |
| $CCl_4$ IP Injection | X | | X | X | X | X | X | |
| Test Article IV Injection | | | | X | X | X | X | |
| Sample Collection (n = 10) | | | | | | | | X |

On day 7 and approximately 24 hours after final IV injection, all remaining mice were sacrificed and the livers were perfused with PBS prior to collecting liver samples for PCR analysis. An approximate 150 mg sample from each mouse liver was collected and placed in 1.5 mL RNALATER® stabilization reagent (Qiagen) and stored at 2-8° C. until analysis. Liver samples were not collected from areas of clear and marked liver damage and/or necrosis.

Total RNA from mouse livers was extracted using RNEASY® columns (Qiagen) according to the manufacturer's protocol. 20 ng of total RNA was used for quantitative RT-PCR for measuring HSP47 expression. HSP47 and GAPDH TAQMAN® assays and One-Step RT-PCR master mix were purchased from Applied Biosystems. Each PCR reaction contained the following composition: One-step RT-PCR mix 5 µl, TAQMAN® RT enzyme mix 0.25 µl, TAQMAN® gene expression assay probe (HSP47) 0.25 µl, TAQMAN® gene expression assay probe (GAPDH) 0.5 µl, RNase free water 3.25 µl, RNA 0.75 µl, to a total volume of 10 µl. GAPDH was used as endogenous control for the relative quantification of HSP47 mRNA levels. Quantitative RT-PCR was performed in VIIA realtime PCR system using an in-built Relative Quantification method. All values were normalized to the average HSP47 expression of the naïve animal group and expressed as percentage of HSP47 expression compared to naïve group.

Figure 21:
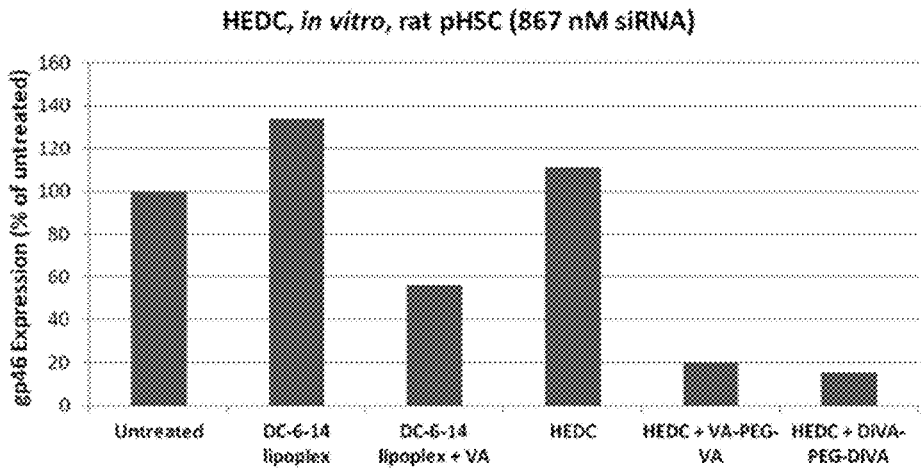
FIG. 21 shows knockdown efficacy of certain embodiments of the description. This includes HEDC liposomes compared to DC-6-14 lipoplex controls.

The formulations described in FIG. 21 are as follows:

| | Molar Ratio | | | | |
|---|---|---|---|---|---|
| Formulation | Cationic Lipid | DOPE | Cholesterol | PEG-lipid | VA or VA-conjugate |
| DC-6-14 Lipoplex | 40 | 30 | 30 | — | — |
| DC-6-14 Lipoplex + VA* | 40 | 30 | 30 | — | 40 |
| HEDC Liposome | 50 | 10 | 38 | 2 | — |
| HEDC Liposome + VA-PEG-VA* | 50 | 10 | 38 | 2 | 5 |
| HEDC Liposome + diVA-PEG-diVA* | 50 | 10 | 38 | 2 | 5 |

Figure 22:
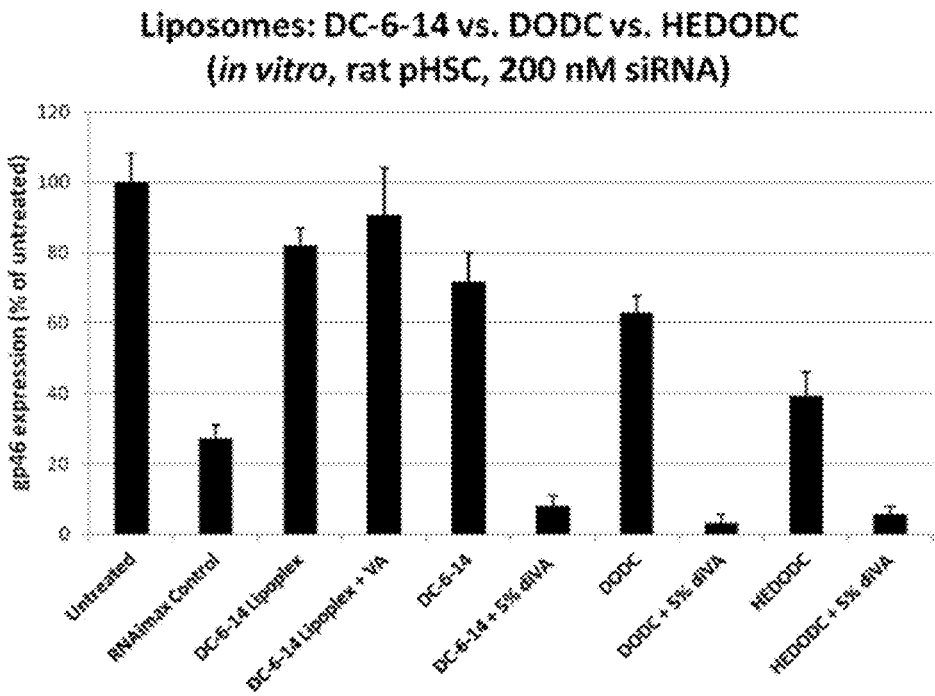
FIG. 22 shows an in vitro comparison of gene knockdown using cationic lipids.

*VA-PEG-VA and diVA-PEG-diVA were added via co-solubilization. VA was added via decoration post-process Additional formulations described in FIG. 22 are as follows

| | Molar Ratio | | | | |
|---|---|---|---|---|---|
| Formulation | Cationic Lipid | DOPE | Cholesterol | PEG-lipid | VA or VA-conjugate |
| DC-6-14 Lipoplex | 40 | 30 | 30 | — | — |
| DC-6-14 Lipoplex + VA* | 40 | 30 | 30 | — | 40 |
| DC-6-14 Liposome | 50 | 10 | 38 | 2 | |
| DC-6-14 Liposome + diVA-PEG-diVA* | 50 | 10 | 38 | 2 | 5 |
| HEDODC Liposome | 50 | 10 | 38 | 2 | — |
| HEDODC Liposome + diva-PEG-diVA* | 50 | 10 | 38 | 2 | 5 |

*diVA-PEG-diVA was added via co-solubilization. VA was added via decoration post-process.

Figure 23:
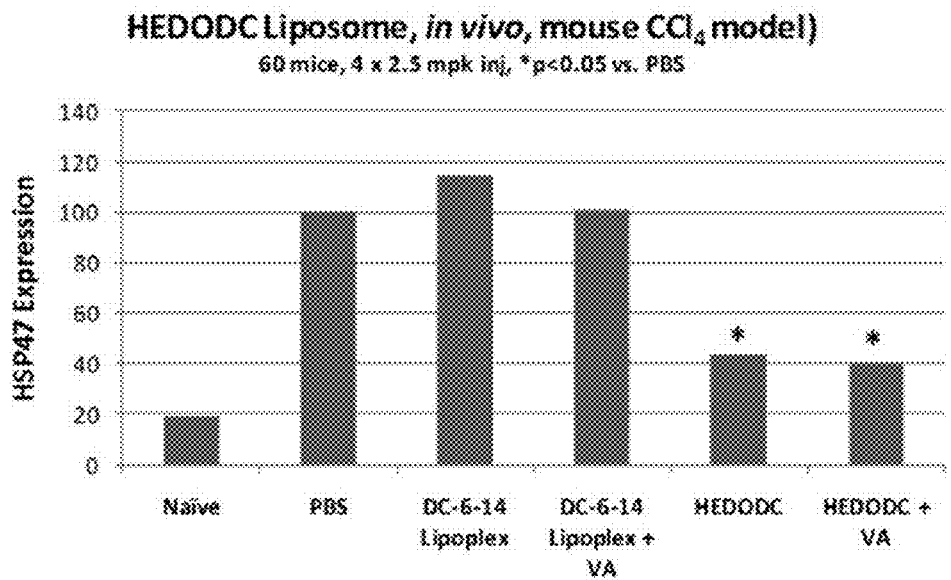
FIG. 23 shows an evaluation of gene expression in vivo with exemplary HEDODC liposome formulations of the invention (* indicates p<0.05).

Additional formulations described in FIG. 23 are were as follows.

| Formulation | Molar Ratio | | | | |
|---|---|---|---|---|---|
| | Cationic Lipid | DOPE | Cholesterol | PEG-lipid | VA or VA-conjugate |
| DC-6-14 Lipoplex | 40 | 30 | 30 | — | — |
| DC-6-14 Lipoplex + VA* | 40 | 30 | 30 | — | 40 |
| HEDODC Liposome | 50 | 10 | 38 | 2 | — |
| HEDODC Liposome + diVA-PEG-diVA* | 50 | 10 | 38 | 2 | 5 |

*diVA-PEG-diVA was added via co-solubilization. VA was added via decoration post-process

Example 39: In Vitro Efficacy (pHSC), Dose Response pHSC in vitro assay description: Primary hepatic stellate cells (pHSC) in a 96-well plate were incubated with formulations (HEDC:S104:DOPE:Chol:Peg-DMPE:DiVA, 20:20:30:25:5:2) of increasing siRNA concentration. After 30 minutes, cells were washed and treated with fresh growth medium and incubated at 37° C. for 48 hours. At that time, cells were lysed and gp46 and GAPDH mRNA levels were measured by quantitative RT-PCR (TAQMAN®) assay. mRNA levels of gp46 were normalized to GAPDH levels. Normalized gp46 levels are expressed as the percent of untreated control cells. Fitting data to a sigmoidal dose-response curve yielded an $EC_{50}$ of 11.8 nM.

Example 40: Toxicity

HepG2 cytotoxicity assay description: HepG2 cells, an adherent cell line derived from human hepatocellular carcinoma, was cultured in MEM/EBSS (Hyclone, Logan, Utah) supplemented with 10% FBS (Hyclone). HepG2 cells were seeded in 96-well Optilux black plates (BD Falcon) at the density of 5000 cells/well overnight. Formulations were added to each well to final indicated siRNA concentration (n=3). At 48 h post formulation addition, cell viability was determined using CellTiter-Glo Luminescent Cell Viability Assay Kit (Promega) following manufacture's instruction. Chemiluminescent signal were measured on Clarity Luminescence Microplate Reader (502-Biotek, Winooski Vt.). Viability was calculated based on percentage of chemiluminescent signal in formulation treated well normalized against mock treated wells.

Figure 24:
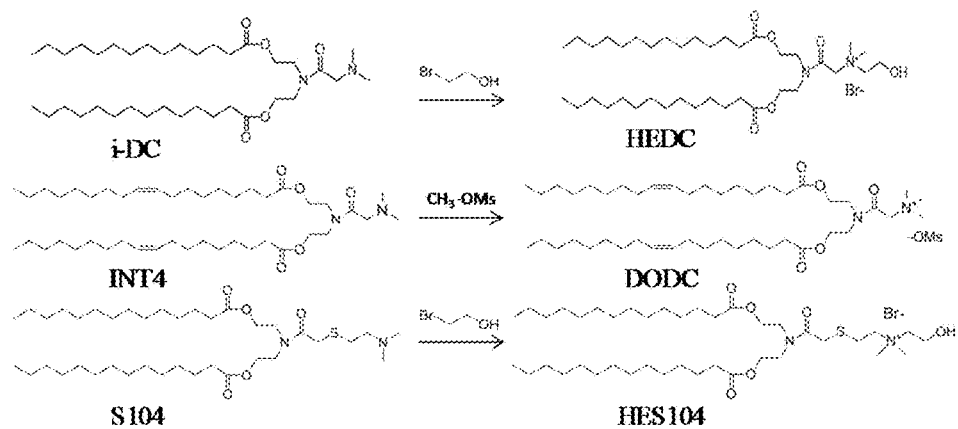
FIG. 24 shows quaternary amine cationic lipids of formula I.

Combinations of quaternary amine cationic lipids of formula I with their respective ionizable synthetic precursors were evaluated (as shown in the examples below, i-DC and HEDC, INT4 and DODC, S104 and HES 104). See FIG. 24.

The following table provides exemplary results from different formulations. Combinations of quaternary amine cationic lipids with ionizable cationic lipids surprisingly and unexpectedly were less toxic than liposomes containing a single cationic lipid (see examples HEDC vs. HEDC+iDC; and DODC vs. DODC+INT4 in the table below). The HEDC+S104 combination was identified as another preferred formulation.

| Variant Description | Formulation Variants | in vitro KD* (%) | in vitro tox (% cell viability, HepG2 @ 200 nM) |
|---|---|---|---|
| Cationic Lipid Content (2 mol % PEG-Lipid) | 40 mol % HEDC, no ionizable lipid | 90% @ 200 nM | 27% |
| | 50 mol % DODC, no ionizable lipid | 90% @ 200 nM | 55% |
| | 25 mol % DODC:25 mol % INT4 | 90% @ 200 nM | 90% |
| | 20 mol % HEDC:20 mol % i-DC | 89% @ 200 nM | 57% |
| | 20 mol % HEDC:20 mol % S104 | 90% @ 200 nM | 52% |
| | 10 mol % HEDC:30 mol % S104 | 90% @ 200 nM | 71% |
| | 5 mol % HEDC:35 mol % S104 | 90% @ 200 nM | 80% |
| PEG Lipid Content (DMPE-PEG) | 2 mol % | | 70% |
| | 5 mol % | | 60% |
| | 7 mol % | | 55% |
| | 10 mol % | | 45% |
| DiVA Content (w/5 mol % DMPE-PEG) | 0.25 mol % | | 35% |
| | 0.5 mol % | | 40% |
| | 1.0 mol % | | 60% |
| | 2.0 mol % | | 70% |
| DOPE:Cholesterol Ratio (w/5 mol % DMPE-PEG) | DOPE-0%:Cholesterol 55% | | 89% |
| | DOPE-5%:Cholesterol 50% | | 82% |
| | DOPE-10%:Cholesterol 45% | | 77% |
| | DOPE-15%:Cholesterol 40% | | 74% |
| | DOPE-20%:Cholesterol 35% | | 80% |
| | DOPE-25%:Cholesterol 30% | | 79% |
| | DOPE-30%:Cholesterol 25% | | 82% |
| | DOPE-35%:Cholesterol 20% | | 80% |
| | DOPE-40%:Cholesterol 15% | | 84% |
| | DOPE-45%:Cholesterol 10% | | 80% |
| | DOPE-50%:Cholesterol 5% | | 78% |
| | DOPE-55%:Cholesterol 0% | | 72% |
| siRNA:Total Lipid Ratio (w/5 mol % DMPE-PEG) | 0.07 | | 80% |
| | 0.09 | | 75% |
| | 0.11 | | 82% |

*All data with 20 mol % HEDC, 20 mol % S104, and 2 mol % DiVA @ 50 nM siRNa dose unless otherwise noted In Vivo Toxicity The HEDC:S104 (20:20) formulation is exceptionally well tolerated in preliminary in vivo toxicity studies. No toxicity is observed when the formulation is injected intravenously at doses up to 25 mg/kg (rat) and 12 mg/kg (monkey).

Example 41: In Vivo Efficacy (Rat DMNQ)

In vivo activity of target formulation was evaluated in the short-term liver damage model (referred to as the Quick Model, DMNQ). In this model, the short-term liver damage induced by treatment with a hepatotoxic agent such as dimethylnitrosamine (DMN) is accompanied by the elevation of gp46 mRNA levels. To induce these changes, male S-D rats were injected intraperitoneally with DMN on six consecutive days. At the end of the DMN treatment period, the animals were randomized to groups based upon individual animal body weight. Formulations were administered as a single intravenous dose, one hour after the last injection of DMN. Twenty four hours later, liver lobes were excised and both gp46 and MRPL19 mRNA levels were determined by quantitative RT-PCR (TAQMAN®) assay. Levels of gp46 mRNA were normalized to MRPL19 levels.

Male S-D rats were treated with DMN at 10 mg/kg on day 1, 2, 3 and 5 mg/kg on day 4, 5, 6 through intraperitoneally dosing to induce liver damage. Animals (n=8/group) were injected intravenously either with formulations at a dose of 0.5, 0.75, 1.0, 2 mg/kg siRNA in a formulation consisting of HEDC:S104:DOPE:Chol:Peg-DMPE:DiVA (20:20:30:25:5:2), or PBS (vehicle), one hour after the last injection of DMN. Twenty four hours later, total siRNA was purified from a section of the right liver lobe from each animal and stored at 4° C. until RNA isolation. Control groups included a PBS vehicle group (DMN-treated) and naïve (untreated; no DMN) group. After subtracting background gp46 mRNA levels determined from the naïve group, all test group values were normalized to the average gp46 mRNA of the vehicle group (expressed as a percent of the vehicle group). The mean gp46 mRNA level following treatment showed dose-dependent response and curve fitting to sigmoidal dose response curve yielded $EC_{50}$ of 0.79 mg/kg.

Example 42: In Vivo Efficacy (Rat DMNC)

Male S-D rats (130-160 g) were treated DMN through intraperitoneally dosing to induce liver fibrosis. The DMN treatment regimen was three times each week with 10 mg/kg (i.e., 5.0 mg/mL of DMN at a dose of 2.0 mL/kg body weight) for first 3 weeks and half dose of 5 mg/kg (i.e., 5 mg/mL of DMN at a dose of 1.0 mL/kg) from day 22 to 57. The sham group animals were injected with PBS (solvent for DMN) using the same schedule. On day 22, 24 h post the last DMN treatment, blood samples were collected and assayed for liver disease biomarkers to confirm the effectiveness of the DMN treatment. DMN treated animals were assigned to different treatment groups based on body weight to ensure that the mean body weights and the range of body weights of the animals in each group have no significant difference. Animals from pretreatment group were sacrificed on day 25 to evaluate the disease progression stage prior to treatment begins. Treatments with formulations containing gp46 siRNA were started at day 25, with two treatments/week at specified siRNA dose for a total of 10 times. On day 59, 48 hours after last formulation treatment and 72 hours after last DMN treatment, animals were sacrificed by $CO_2$ inhalation. Liver lobes were excised and both gp46 and MRPL19 mRNA levels were determined by quantitative RT-PCR (TAQMAN®) assay. mRNA levels for gp46 were normalized to MRPL19 levels.

Figure 25:
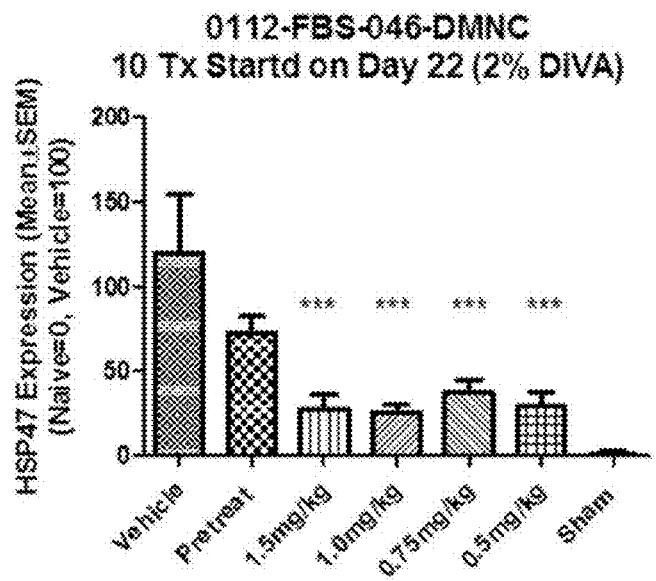
FIG. 25 shows the results of measurements in vivo using a rat DMNC model. After subtracting background gp46 mRNA levels determined from the naïve group, all test group values were normalized to the average gp46 mRNA of the vehicle group (expressed as a percent of the vehicle group). MRPL19 mRNA levels were determined by quantitative RT-PCR (TAQMAN®) assay. mRNA levels for gp46 were normalized to MRPL19 levels. (*** indicates p<0.02.)
FIG. 26A shows preparation of DOPE-Glu-VA.

Male S-D rats were treated with DMN at 10 mg/kg for three weeks (three times/week) and then 5 mg/kg from day 22 to 57 (three times/week) through intraperitoneal dosing to induce liver fibrosis. Animals (n=ten/group) were injected intravenously either with formulations consisting of HEDC:S104:DOPE:Chol:Peg-DMPE:DiVA (20:20:30:25:5:2) at 1.5, 1.0, 0.75, and 0.5 mg/kg siRNA or PBS (vehicle) for 10 times (2 times/week), one hour after the last injection of DMN. At day 59, total siRNA was purified from a section of the right liver lobe from each animal and stored at 4° C. until RNA analysis. Control groups included a PBS vehicle group (DMN-induced, PBS treated, n=7) and sham group (PBS treated in place of DMN and formulation, n=10) group. FIG. 25 shows the results of measurements. After subtracting background gp46 mRNA levels determined from the naïve group, all test group values were normalized to the average gp46 mRNA of the vehicle group (expressed as a percent of the vehicle group). Animal from pretreat group (n=7) were sacrificed on day 25 to evaluate disease progression level prior to treatment began. One-way Anova analysis followed by Dunnett's test showed significant gp46 gene knockdown in all treatment groups as compared to vehicle group (***, P<0.001).

The following table summarizes the compounds described herein, and the results obtained by testing these compounds in vivo and in vitro.

| Cationic Lipid Name | in vitro (pHSC) % KD | in vivo (rat DMNQ) % KD |
|---|---|---|
| Pr-HEDC | 75% @ 50 nM | |
| Pr-HE-DODC | 73% @ 50 nM | |
| HE-Et-DC | 70% @ 50 nM | |
| HE-Et-DODC | 71% @ 50 nM | |
| HE-Pr-DC | 47% @ 50 nM | |
| HE-Pr-DODC | 75% @ 50 nM | |
| HE2DODC | 78% @ 50 nM | |
| HEDC-DLin | 50% @ 50 nM | |
| HEDC | 68% @ 50 nM | 52% @ 0.5 mpk |
| HEDC-12 | 0% @ 50 nM | |

Example 43: Synthesis of DOPE-Glu-VA

Figure 26A:
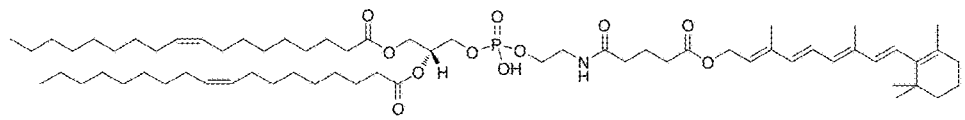
FIG. 26B shows preparation of 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid.
FIG. 26C shows preparation of (Z)-(2R)-3-(((2-(5-(((2E, 4E,6E,8E)-3,7-dimethyl-9-(2,6,6-trimethylcyclohex-1-en-1-yl)nona-2,4,6,8-tetraen-1-yl)oxy)-5-oxopentanamido) ethoxy)(hydroxy)phosphoryl)oxy)propane-1,2-diyl dioleate.

Preparation of DOPE-Glu-VA: (Z)-(2R)-3-(((2-(5-(((2E,4E,6E,8E)-3,7-dimethyl-9-(2,6,6-trimethylcyclohex-1-en-1-yl)nona-2,4,6,8-tetraen-1-yl)oxy)-5-oxopentanamido)ethoxy)(hydroxy)phosphoryl)oxy)propane-1,2-diyl dioleate (FIG. 26A).

Figure 26B:
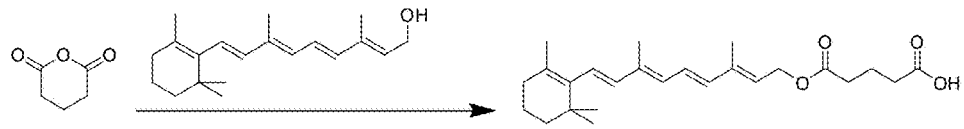

Preparation of 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid (FIG. 26B).

Glutaric anhydride (220 mg, 1.93 mmol) and retinol (500 mg, 1.75 mmol) were dissolved in dichloromethane (5 mL) in an amber-colored vial. Triethylamine (513 μl, 3.68 mmol) was added and the vial was flushed with argon. Reaction mixture was stirred at room temperature for 4 hours. The material was concentrated and purified by silica gel chromatography with a dichloromethane/methanol gradient. Fractions were pooled and concentrated to yield yellowish oil (700 mg). The product was verified by NMR.

Figure 26C:
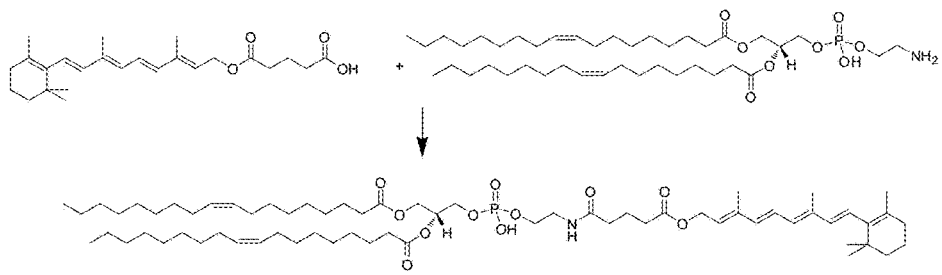

Preparation of DOPE-Glu-VA: (Z)-(2R)-3-(((2-(5-(((2E,4E,6E,8E)-3,7-dimethyl-9-(2,6,6-trimethylcyclohex-1-en- 1-yl)nona-2,4,6,8-tetraen-1-yl)oxy)-5-oxopentanamido)ethoxy)(hydroxy)phosphoryl)oxy)propane-1,2-diyl dioleate (FIG. 26C).

1,2-dioleoyl-sn-glycero-3-phosphoethanolamine (500 mg, 0.672 mmol), N,N,N',N'-tetramethyl-O-(7-azabenzotriazol-1-yl)uronium hexafluorophosphate (306.5 mg, 0.806 mmol) and 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid (269 mg, 0.672 mmol) was dissolved in chloroform/DMF (10 mL, 1:1 mixture) in an amber-colored vial flushed with argon and N,N-Diisopropylethylamine (300 μL, 1.68 mmol) was added. Reaction mixture was stirred for 12 hours at room temperature. The reaction mixture was concentrated and then purified by silica gel chromatography using a dichloromethane/methanol gradient. The fractions were pooled and concentrated to yield yellowish oil (460 mg, 61%). Verified product by NMR. $^1$H NMR (400 MHz), $\delta_H$: 8.6 (d, 1H), 8.27 (d, 1H), 6.57-6.61 (dd, 1H), 6.08-6.25 (m, 4H), 5.57 (t, 1H), 5.30-5.34 (m, 4H), 5.18 (m, 1H), 4.68-4.70 (d, 2H), 4.28-4.35 (m, 1H), 4.05-4.15 (m, 1H), 3.81-3.97 (m, 4H), 3.52-3.62 (m, 1H), 3.35-3.45 (m, 2H), 2.95-3.05 (m, 1H), 2.33-2.35 (t, 3H), 2.2-2.3 (m, 7H), 1.9-2.05 (m, 17H), 1.85 (s, 3H), 1.69 (s, 3H), 1.5-1.65 (m, 6H), 1.4-1.5 (m, 2H), 1.18-1.38 (m, ~40H), 1.01 (s, 3H), 0.84-0.88 (m, 12H).

Example 44: DOPE-Glu-NH-VA

Figure 27A:
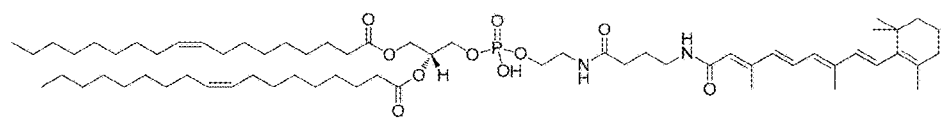
FIG. 27A shows preparation of DOPE-Glu-NH-VA.

Preparation of DOPE-Glu-NH-VA
(Z)-(2R)-3-(((2-(4-((2E,4E,6E,8E)-3,7-dimethyl-9-(2,6,6-trimethylcyclohex-1-en-1-yl)nona-2,4,6,8-tetraenamido)butanamido)ethoxy)(hydroxy)phosphoryl)oxy)propane-1,2-diyl dioleate (FIG. 27A).

Figure 27B:
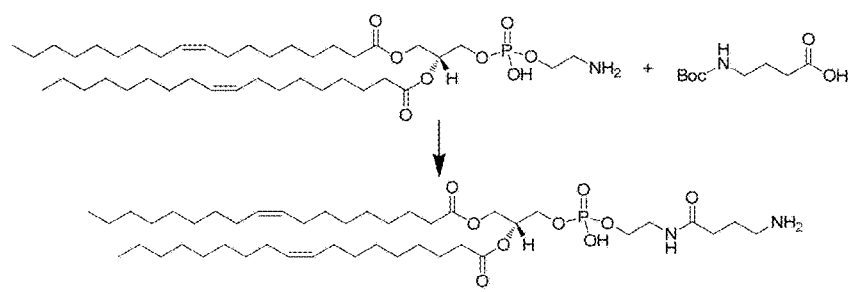
FIG. 27B shows preparation of (Z)-(2R)-3-(((2-(4-aminobutanamido)ethoxy)(hydroxy)phosphoryl)oxy)propane-1, 2-diyl dioleate.

Preparation of (Z)-(2R)-3-(((2-(4-aminobutanamido)ethoxy)(hydroxy)phosphoryl)oxy)propane-1,2-diyl dioleate (FIG. 27B). 1,2-dioleoyl-sn-glycero-3-phosphoethanolamine (2500 mg, 3.36 mmol), Boc-GABA-OH (751 mg, 3.70 mmol) and N,N,N',N'-tetramethyl-O-(7-azabenzotriazol-1-yl)uronium hexafluorophosphate (1531 mg, 4.03 mmol) were dissolved in a DMF/chloroform (25 mL, 1:1 mixture). N,N-Diisopropylethylamine (880 μL, 5.05 mmol) was added and the mixture was stirred at room temperature for 12 hours under a blanket of argon. The reaction mixture was diluted with ~200 mL H$_2$O and product was extracted with dichloromethane (3×100 ml). The product was washed with ~75 mL pH 4.0 PBS buffered water, dried with sodium sulfate, filtered and concentrated. Material was then purified via silica gel chromatography with a dichloromethane/methanol gradient, and concentrated to yield colorless oil (2.01 g, 64%). The product was verified by NMR. Material was then taken up in 30 mL of 2 M HCl/diethyl ether. Reaction was allowed to stir at room temperature in a water bath. After 2 hours, the solution was concentrated to yield (Z)-(2R)-3-(((2-(4-aminobutanamido)ethoxy)(hydroxy)phosphoryl)oxy)propane-1,2-diyl dioleate.

Figure 27C:
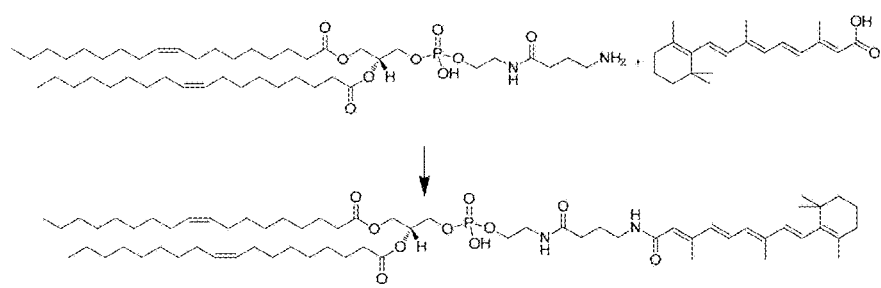
FIG. 27C shows preparation of DOPE-Glu-NH-VA.

Preparation of DOPE-Glu-NH-VA: (Z)-(2R)-3-(((2-(4-((2E,4E,6E,8E)-3,7-dimethyl-9-(2,6,6-trimethylcyclohex-1-en-1-yl)nona-2,4,6,8-tetraenamido)butanamido)ethoxy)(hydroxy)phosphoryl)oxy)propane-1,2-diyl dioleate (FIG. 27C). (Z)-(2R)-3-(((2-(4-aminobutanamido)ethoxy)(hydroxy)phosphoryl)oxy)propane-1,2-diyl dioleate (1200 mg, 1.45 mmol), retinoic acid (500 mg, 1.66 mmol) and N,N,N',N'-tetramethyl-O-(7-azabenzotriazol-1-yl)uronium hexafluorophosphate (689 mg, 1.81 mmol) was suspended in DMF/chloroform (10 mL, 1:1 mixture). N,N-Diisopropylethylamine (758 μL, 4.35 mmol) was added. The reaction mixture was flushed with argon, covered with aluminum foil, and stirred at room temperature for 4 hours, then partitioned in dichloromethane (75 mL) and water (75 mL), extracted with dichloromethane, dried (sodium sulfate), filtered and concentrated. Purification by silica gel chromatography using a dichloromethane/methanol gradient yielded (Z)-(2R)-3-(((2-(4-((2E,4E,6E,8E)-3,7-dimethyl-9-(2,6,6-trimethylcyclohex-1-en-1-yl)nona-2,4,6,8-tetraenamido)butanamido)ethoxy)(hydroxy)phosphoryl)oxy)propane-1,2-diyl dioleate (292 mg, 18%). The product was characterized by LCMS and NMR. $^1$H NMR (400 MHz), $\delta_H$: 8.55 (s, 1H), 8.2 (d, 1H), 7.3 (s, 1H), 6.6 (dd, 1H), 6.10-6.27 (m, 5H), 5.5 (t, 1H), 5.31 (s, 4H), 5.1-5.2 (m, 2H), 4.68 (d, 2H), 4.3 (d, 2H), 4.1 (m, 2H), 3.9 (m, 8H), 3.58 (q, 4H), 3.4 (s, 4H), 3.0 (q, 4H), 2.33-2.35 (t, 3H), 2.2-2.3 (m, 7H), 1.9-2.05 (m, 17H), 1.85 (s, 3H), 1.69 (s, 3H), 1.5-1.65 (m, 6H), 1.4-1.5 (m, 2H), 1.18-1.38 (m, ~40H), 1.01 (s, 3H), 0.84-0.88 (m, 12H). MS: m/z 1112.44 (M+H$^+$).

Example 45: DSPE-PEG550-VA

Figure 28A:
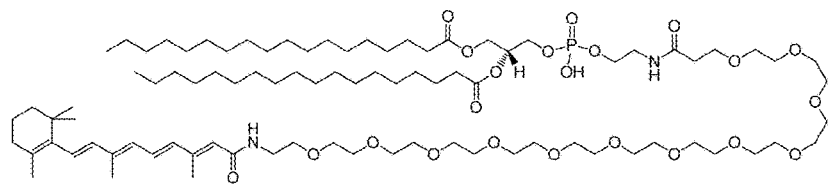
FIG. 28A shows the structure of DSPE-PEG550-VA.

Preparation of DSPE-PEG550-VA: (2R)-3-(((((45E,47E,49E,51E)-46,50-dimethyl-4,44-dioxo-52-(2,6,6-trimethylcyclohex-1-en-1-yl)-7,10,13,16,19,22,25,28,31,34,37,40-dodecaoxa-3,43-diazadopentaconta-45,47,49,51-tetraen-1-yl)oxy)(hydroxy)phosphoryl)oxy)propane-1,2-diyl distearate (FIG. 28A).

Figure 28B:
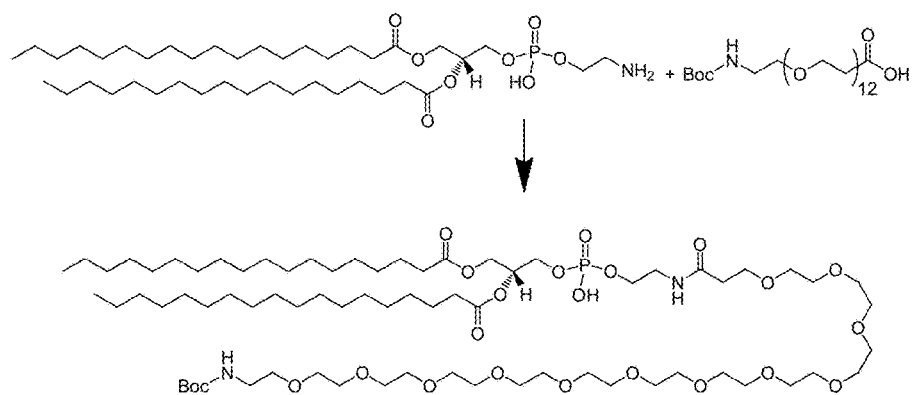
FIG. 28B shows preparation of (2R)-3-(((((2,2-dimethyl-4,44-dioxo-3,8,11,14,17,20,23,26,29,32,35,38,41-tridecaoxa-5,45-diazaheptatetracontan-47-yl)oxy)(hydroxy) phosphoryl)oxy)propane-1,2-diyl distearate.

Preparation of (2R)-3-((((2,2-dimethyl-4,44-dioxo-3,8,11,14,17,20,23,26,29,32,35,38,41-tridecaoxa-5,45-diazaheptatetracontan-47-yl)oxy)(hydroxy)phosphoryl)oxy)propane-1,2-diyl distearate (FIG. 28B).

1,2-distearoyl-sn-glycero-3-phosphoethanolamine (200 mg, 0.267 mmol), t-Boc-N-amido-dPEG$_{12}$-acid (211 mg, 0.294 mmol) and N,N,N',N'-tetramethyl-O-(7-azabenzotriazol-1-yl)uronium hexafluorophosphate (122 mg, 0.320 mmol) were dissolved in a chloroform/methanol/H$_2$O (6 mL, 65:35:8) in a 20 mL scintillation vial flushed with argon. N,N-Diisopropylethylamine (116 μL, 0.668 mmol) was added. Reaction was stirred at 25° C. for 4 hours and concentrated. Material was then purified via silica gel chromatography with a dichloromethane/methanol gradient to yield (2R)-3-((((2,2-dimethyl-4,44-dioxo-3,8,11,14,17,20,23,26,29,32,35,38,41-tridecaoxa-5,45-diazaheptatetracontan-47-yl)oxy)(hydroxy)phosphoryl)oxy)propane-1,2-diyl distearate as an oil (252 mg, 65%).

Figure 28C:
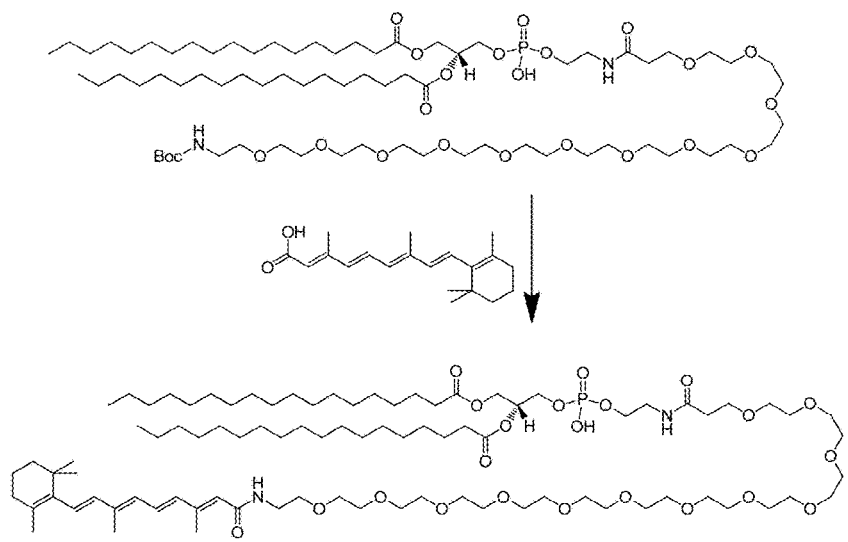
FIG. 28C shows preparation of DSPE-PEG550-VA.

Preparation of DSPE-PEG550-VA: (2R)-3-(((((45E,47E,49E,51E)-46,50-dimethyl-4,44-dioxo-52-(2,6,6-trimethylcyclohex-1-en-1-yl)-7,10,13,16,19,22,25,28,31,34,37,40-dodecaoxa-3,43-diazadopentaconta-45,47,49,51-tetraen-1-yl)oxy)(hydroxy)phosphoryl)oxy)propane-1,2-diyl distearate (FIG. 28C). (2R)-3-((((2,2-dimethyl-4,44-dioxo-3,8,11,14,17,20,23,26,29,32,35,38,41-tridecaoxa-5,45-diazaheptatetracontan-47-yl)oxy)(hydroxy)phosphoryl)oxy)propane-1,2-diyl distearate (252 mg, 0.174 mmol) was dissolved in diethyl ether (5 mL). Reaction was placed in a water bath at room temperature. 2 M HCl/diethyl ether (2 mL, 4 mmol) was added and the mixture was stirred for 1 hour. Afterwards, solvent and excess HCl were removed in vacuo. Suspended material in 2 mL N,N-dimethylformamide in a flask flushed with argon. Retinoic acid (57.5 mg, 0.191 mmol), N,N,N',N'-tetramethyl-O-(7-azabenzotriazol-1-yl)uronium hexafluorophosphate (79 mg, 0.209 mmol) and N,N-diisopropylethylamine (106 μL, 0.609 mmol) were added. More chloroform/methanol/H$_2$O was added (1 mL, 65:35:8 v:v:v mixture) to dissolve the reactants. After 3.5 hours, the reaction mixture was concentrated. Material was then purified via silica gel chromatography with a dichloromethane/methanol gradient to yield (2R)-3-(((((45E,47E, 49E,51E)-46,50-dimethyl-4,44-dioxo-52-(2,6,6-trimethyl-cyclohex-1-en-1-yl)-7,10,13,16,19,22,25,28,31,34,37,40-dodecaoxa-3,43-diazadopentaconta-45,47,49,51-tetraen-1-yl)oxy)(hydroxy)phosphoryl)oxy)propane-1,2-diyl distearate as a tan solid (210 mg, 74%). Verified product by NMR and LCMS. $^1$H NMR (400 MHz), $\delta_H$: 8.6 (s, 1H), 8.25 (d, 1H), 6.8-6.9 (dd, 1H), 6.3-6.4 (m, 1H), 6.12-6.25 (dd, 5H), 5.71 (s, 1H), 5.18 (m, 2H), 4.33 (dd, 2H), 4.13 (m, 2H), 3.95 (m, 2H), 3.74 (m, 8H), 3.63 (s, ~48H), 3.0 (q, 2H), 2.5 (t, 3H), 2.35 (s, 3H), 2.25 (t, 8H), 1.97 (m, 7H), 1.7 (3, 3H), 1.5 (m, 2H), 1.36 (m, 12H), 1.23 (m, ~56H), 1.01 (s, 6H), 0.86 (t, 12H). MS: m/z 1630.28 (M+H$^+$).

Example 46: DSPE-PEG2000-Glu-VA

Figure 29A:
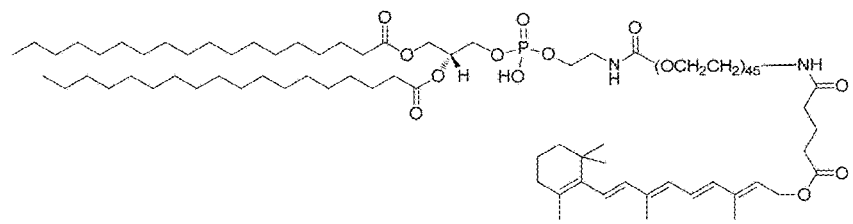
FIG. 29A shows the structure of DSPE-PEG2000-Glu-VA.

Preparation of DSPE-PEG2000-Glu-VA (FIG. 29A).

Figure 29B:
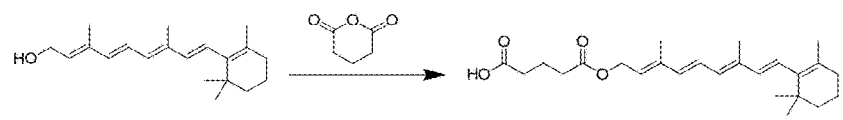
FIG. 29B shows preparation of 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid.

Preparation of 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid (FIG. 29B). Glutaric anhydride (115 mg, 1.01 mmol) and retinol (240 mg, 0.838 mmol) were dissolved in dichloromethane (3 mL) in an amber-colored vial. Triethylamine (257 ul, 1.84 mmol) was added and the vial was flushed with argon. Reaction was stirred at room temperature for 12 hours. The reaction mixture was concentrated and then purified via silica gel chromatography with a dichloromethane/methanol gradient to yield 5-(((2E,4E,6E,8E)-3,7-dimethyl-9-(2,6,6-trimethylcyclohex-1-en-1-yl)nona-2,4,6,8-tetraen-1-yl)oxy)-5-oxopentanoic acid as a yellowish oil (700 mg, 78%). Material characterized by NMR.

Figure 29C:
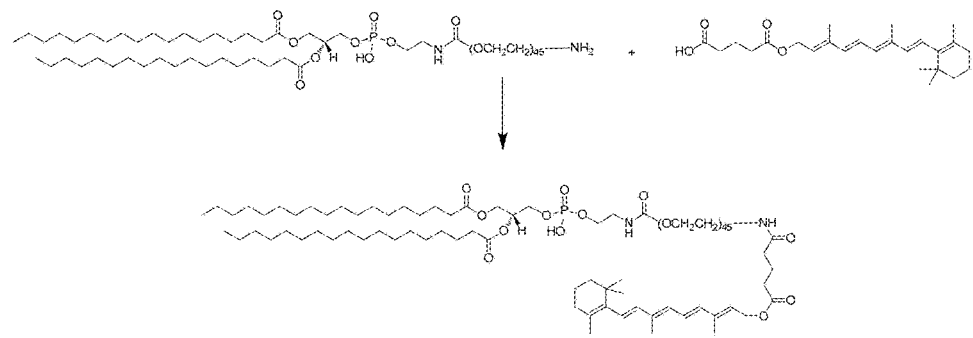
FIG. 29C shows preparation of DSPE-PEG2000-Glu-VA.

Preparation of DSPE-PEG2000-Glu-VA (FIG. 29C). 5-(((2E,4E,6E,8E)-3,7-dimethyl-9-(2,6,6-trimethylcyclo-hex-1-en-1-yl)nona-2,4,6,8-tetraen-1-yl)oxy)-5-oxopentanoic acid (43 mg, 0.108 mmol), DSPE-PEG2000-NH$_2$ (250 mg, 0.090 mmol) and N,N,N',N'-tetramethyl-O-(7-azabenzotriazol-1-yl)uronium hexafluorophosphate (45 mg, 0.117 mmol) were dissolved in N,N-dimethylformamide (2 mL) in an amber-colored scintillation vial flushed with argon gas. N,N-diisopropylethylamine (47 μL, 0.270 mmol) was added and the reaction stirred for 12 hours at room temperature, then purified via silica gel chromatography with a dichloromethane/methanol gradient to yield yellowish oil (59 mg, 20.7%). Verified product by NMR. $^1$H NMR (400 MHz), $\delta_H$: 706 (m, 1H), 6.59-6.66 (dd, 1H), 6.06-6.30 (m 5H), 5.56-5.60 (t, 1H), 5.17-5.23 (m, 2H), 4.35-4.42 (dd, 2H), 4.12-4.25 (m, 5H), 3.96-3.97 (m, 6H), 3.79-3.81 (t, 1H), 3.66 (m, ~180H), 3.51-3.58 (m, 2H), 3.4-3.48 (m, 4H), 3.3-3.38 (m, 2H), 2.25-2.45 (m, 14H), 1.5-2.0 (m, 15H), 1.23-1.32 (m, ~56H), 1.01 (s, 3H), 0.85-0.88 (t, 12H).

Example 47: DOPE-Gly$_3$-VA

Figure 30A:
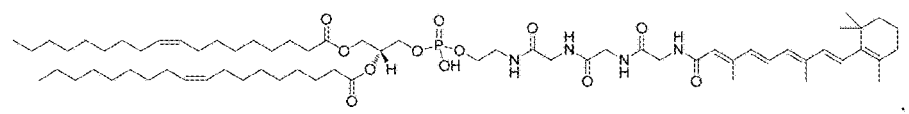
FIG. 30A shows the structure of DOPE-Gly$_3$-VA.

Preparation of DOPE-Gly$_3$-VA: (Z)-(2R)-3-(((((14E,16E,18E,20E)-15,19-dimethyl-4,7,10,13-tetraoxo-21-(2,6,6-trimethylcyclohex-1-en-1-yl)-3,6,9,12-tetraazahenicosa-14,16,18,20-tetraen-1-yl)oxy)(hydroxy)phosphoryl)oxy)propane-1,2-diyl dioleate (FIG. 30A).

Figure 30B:
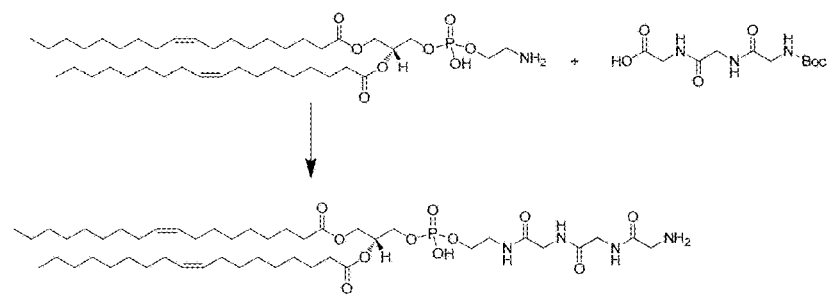
FIG. 30B shows preparation of (Z)-(2R)-3-(((2-(2-(2-(2-aminoacetamido)acetamido)acetamido)ethoxy)(hydroxy)phosphoryl)oxy)propane-1,2-diyl dioleate.

Preparation of (Z)-(2R)-3-(((2-(2-(2-(2-aminoacetamido)acetamido)acetamido)ethoxy)(hydroxy)phosphoryl)oxy)propane-1,2-diyl dioleate (FIG. 30B).

Boc-Gly-Gly-Gly-OH (382 mg, 1.34 mmol) and N,N,N',N'-tetramethyl-O-(7-azabenzotriazol-1-yl)uronium hexafluorophosphate (532 mg, 1.4 mmol) were dissolved in DMF (5 mL). N,N-Diisopropylethylamine (488 μL, 2.8 mmol) was added and the mixture was allowed to stir at room temperature for 10-15 minutes. Afterwards, a solution of 1,2-dioleoyl-sn-glycero-3-phosphoethanolamine (833 mg, 1.12 mmol) in chloroform (5 mL) was added and the reaction vessel was flushed with argon. After 16 hours at room temperature, the reaction mixture was concentrated and partitioned between dichloromethane (50 mL) and water (50 mL), extracted with dichloromethane (3×50 mL), dried with sodium sulfate, filtered and concentrated. Material was purified via silica gel chromatography using a dichloromethane/methanol gradient to yield colorless oil residue. To this, 2 M HCl/diethyl ether (5 mL) was added and the reaction mixture was allowed to stir in a water bath for approximately 2 hours. The reaction mixture was concentrated and the residue was taken up in dichloromethane (75 mL), washed with saturated sodium bicarbonate solution (75 mL), extracted product with dichloromethane (3×75 mL), dried with sodium sulfate, filtered and concentrated to yield (Z)-(2R)-3-(((2-(2-(2-(2-aminoacetamido)acetamido)acetamido)ethoxy)(hydroxy)phosphoryl)oxy)propane-1,2-diyl dioleate as a semi-solid (765 mg, 90%). Verified by NMR.

Figure 30C:
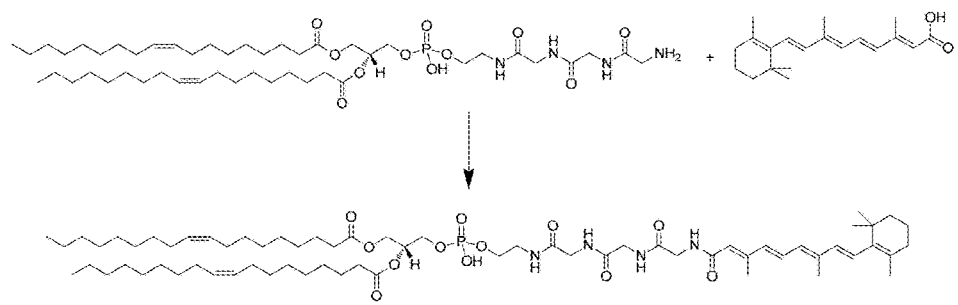
FIG. 30C shows preparation of DOPE-Gly$_3$-VA.

Preparation of DOPE-Gly$_3$-VA: (Z)-(2R)-3-(((((14E,16E,18E,20E)-15,19-dimethyl-4,7,10,13-tetraoxo-21-(2,6,6-trimethylcyclohex-1-en-1-yl)-3,6,9,12-tetraazahenicosa-14,16,18,20-tetraen-1-yl)oxy)(hydroxy)phosphoryl)oxy)propane-1,2-diyl dioleate (FIG. 30C). (Z)-(2R)-3-(((2-(2-(2-(2-aminoacetamido)acetamido)acetamido)ethoxy)(hydroxy)phosphoryl)oxy)propane-1,2-diyl dioleate (765 mg, 0.836 mmol), retinoic acid (301 mg, 1.00 mmol), and N,N,N',N'-tetramethyl-O-(7-azabenzotriazol-1-yl)uronium hexafluorophosphate (413 mg, 1.09 mmol) were suspended in N,N-dimethylformamide (5 mL). N,N-Diisopropylethylamine (437 μL, 2.51 mmol) was added and the reaction vessel was flushed with argon gas. Added chloroform (5 mL) to aid in the solvation of materials. Reaction was stirred for ~4 hours at room temperature in a round bottom flask covered with aluminum foil. Partitioned material between water (100 mL) and dichloromethane (100 mL). Extracted with dichloromethane (3×100 mL), dried with sodium sulfate, filtered and concentrated. Material was then purified via silica gel chromatography using a dichloromethane/methanol gradient to yield (Z)-(2R)-3-(((((14E,16E,18E,20E)-15,19-dimethyl-4,7,10,13-tetraoxo-21-(2,6,6-trimethylcyclohex-1-en-1-yl)-3,6,9,12-tetraazahenicosa-14,16,18,20-tetraen-1-yl)oxy)(hydroxy)phosphoryl)oxy)propane-1,2-diyl dioleate as an orange oil (704 mg, 70%). Verified product by LCMS and NMR. $^1$H NMR (400 MHz), $\delta_H$: 6.90 (t, 1H), 6.21 (q, 2H), 6.08-6.12 (d, 2H), 5.83 (s, 1H), 5.31 (s, 4H), 5.30 (s, 2H), 4.37 (d, 1H), 4.15 (m, 1H), 3.91 (m, 8H), 3.59 (m, 2H), 3.29 (m, 2H), 3.01 (m, 2H), 2.28 (m, 6H), 1.95-1.98 (m, 12H), 1.44 (s, 3H), 1.5-1.6 (m, 2H), 1.44 (m, 6H), 1.24 (m, ~48H), 1.00 (s, 6H), 0.86 (t, 3H). MS: m/z 1198.42 (M+H$^+$).

Example 48: VA-PEG-VA

Preparation of VA-PEG-VA: N1,N19-bis((16E,18E,20E,22E)-17,21-dimethyl-15-oxo-23-(2,6,6-trimethylcyclohex-1-en-1-yl)-4,7,10-trioxa-14-azatricosa-16,18,20,22-tetraen-1-yl)-4,7,10,13,16-pentaoxanonadecane-1,19-diamide (FIG. 31A).

Figure 31B:
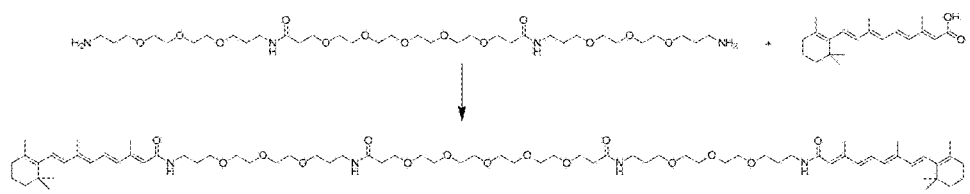
FIG. 31B shows preparation of VA-PEG-VA.

Preparation of VA-PEG-VA: N1,N19-bis((16E,18E,20E,22E)-17,21-dimethyl-15-oxo-23-(2,6,6-trimethylcyclohex-1-en-1-yl)-4,7,10-trioxa-14-azatricosa-16,18,20,22-tetraen-1-yl)-4,7,10,13,16-pentaoxanonadecane-1,19-diamide (FIG. 31B). Retinoic acid (2913 mg, 9.70 mmol), N,N,N',N'-tetramethyl-O-(7-azabenzotriazol-1-yl)uronium hexafluorophosphate (3992 mg, 10.50 mmol) and diamido-dPEG$_{11}$-diamine (3000 mg, 4.04 mmol) were suspended in N,N-dimethylformamide (10 mL). N,N-Diisopropylethylamine (4222 µL, 24.24 mmol) was added and the vessel was flushed with argon. Reaction was stirred at room temperature 12 hours in a round bottom flask covered with aluminum foil. Partitioned material between ethyl acetate (125 mL) and water (125 mL). Extracted with ethyl acetate (3×125 mL), dried with sodium sulfate, filtered and concentrated. Material was then purified via silica gel chromatography with a dichloromethane/methanol gradient. Pooled fractions and concentrated to yield yellow oil (2900 mg, 54.9%). Verified product by LCMS and NMR. $^1$H NMR (400 MHz), $\delta_H$: 7.1 (s, 2H), 6.87 (t, 2H), 6.51 (t, 2H), 6.12-6.20 (dd, 8H), 5.66 (s, 2H), 3.6-3.8 (m, ~44H), 3.4 (q, 4H), 3.3 (q, 4H), 2.46 (t, 4H), 2.32 (s, 6H), 1.9-2.05 (m, 10H), 1.7-1.85 (m, 15H), 1.6 (m, 4H), 1.3-1.5 (m, 6H), 1.01 (s, 12H). QTOF MS: m/z 1306 (M+H$^+$).

Example 49: VA-PEG2000-VA

Figure 32A:
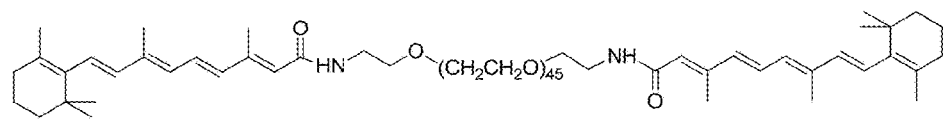
FIG. 32A shows the structure of VA-PEG2000-VA.
Figure 32B:
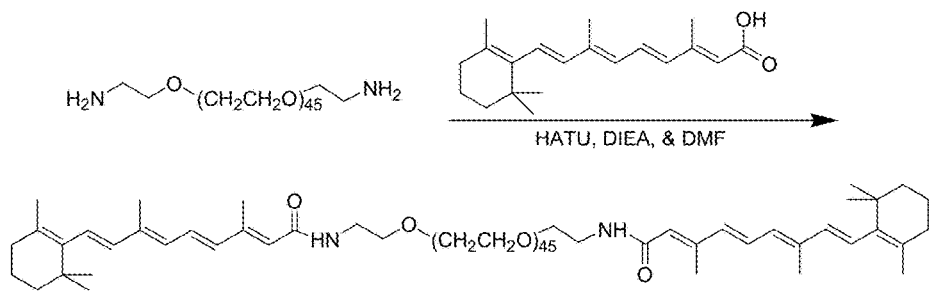
FIG. 32B shows preparation of VA-PEG2000-VA.

Preparation of (2E,2'E,4E,4'E,6E,6'E,8E,8'E)-N,N'-(3,6,9,12,15,18,21,24,27,30,33,36,39,42,45,48,51,54,57,60,63,66,69,72,75,78,81,84,87,90,93,96, 99,102,105,108,111,114,117,120,123,126,129,132,135,138-hexatetracontaoxatetracontahectane-1,140-diyl)bis(3,7-dimethyl-9-(2,6,6-trimethylcyclohex-1-en-1-yl)nona-2,4,6,8-tetraenamide) (VA-PEG2000-VA) (FIG. 32A).
Preparation of VA-PEG2000-VA: (2E,2'E,4E,4'E,6E,6'E,8E,8'E)-N,N'-(3,6,9,12,15,18,21,24,27,30,33,36,39,42,45,48,51,54,57,60,63,66,69,72,75,78,81,84,87,90,93,96,99,102,105,108,111,114,117,120,123,126,129,132,135,138-hexatetracontaoxatetracontahectane-1,140-diyl)bis(3,7-dimethyl-9-(2,6,6-trimethylcyclohex-1-en-1-yl)nona-2,4,6,8-tetraenamide) (FIG. 32B). Retinoic acid (109 mg, 0.362 mmol), N,N,N',N'-tetramethyl-O-(7-azabenzotriazol-1-yl) uronium hexafluorophosphate (149 mg, 0.392 mmol) and amine-PEG$_{2K}$-amine (333 mg, 0.151 mmol) were suspended in N,N-dimethylformamide (3 mL). N,N-Diisopropylethylamine (158 µL, 0.906 mmol) was added and the vessel was flushed with argon. Reaction was allowed to stir at room temperature for 12 hours in a round bottom flask covered with aluminum foil. Partitioned material between ethyl acetate (30 mL) and water (30 mL). Extracted with ethyl acetate (3×30 mL), dried with sodium sulfate, filtered and concentrated. Material was then purified via silica gel chromatography with a dichloromethane/methanol gradient. Pooled fractions and concentrated to yield (2E,2'E,4E,4'E,6E,6'E,8E,8'E)-N,N'-(3,6,9,12,15,18,21,24,27,30,33,36,39,42,45,48,51,54,57,60,63,66,69,72,75,78,81,84,87,90,93,96,99,102,105,108,111,114,117,120,123,126,129,132,135,138-hexatetracontaoxatetracontahectane-1,140-diyl)bis(3,7-dimethyl-9-(2,6,6-trimethylcyclohex-1-en-1-yl)nona-2,4,6,8-tetraenamide) as a yellow oil (97 mg, 23%). Verified product by LCMS and NMR. $^1$H NMR (400 MHz), $\delta_H$: 6.85-6.92 (t, 2h), 6.20-6.32 (M, 6H), 6.08-6.12 (d, 4H), 5.72 (s, 2H), 3.55-3.70 (m, ~180H), 3.4-3.5 (m, 4H), 2.79 (m, 4H), 2.78 (s, 6H), 2.33 (s, 6H), 2.05 (m, 4H), 1.97 (s, 6H), 1.80 (m, 2H), 1.79 (s, 6H), 1.69 (s, 6H), 1.60 (m, 4H), 1.45 (m, 4H), 1.01 (s, 12H). QTOF MS: m/z 2651 (M+H$^+$).

Figure 33A:
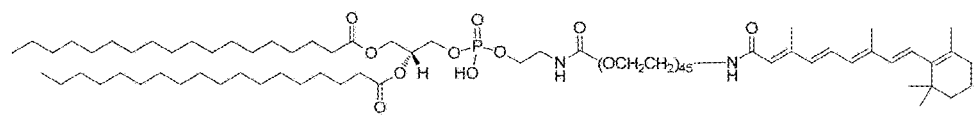
FIG. 33A shows the structure of DSPE-PEG2000-VA.

Example 50: DSPE-PEG2000-VA (FIG. 33A)

Figure 33B:
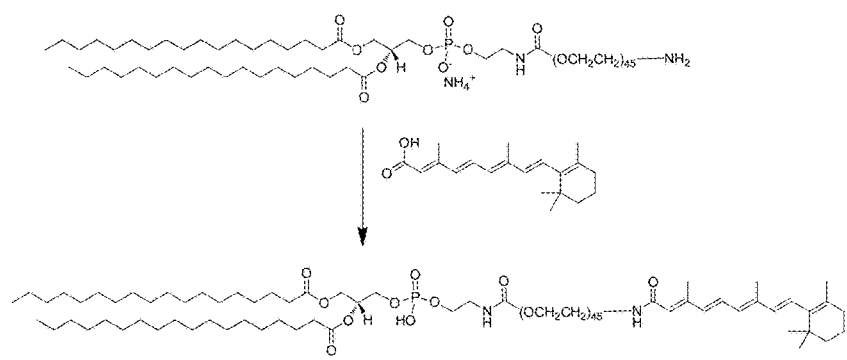
FIG. 33B shows preparation of DSPE-PEG2000-VA.

Preparation of DSPE-PEG2000-VA (FIG. 33B). DSPE-PEG2000-NH$_2$ (250 mg, 0.090 mmol), retinoic acid (3 3 mg, 0.108 mmol) and N,N,N',N'-tetramethyl-O-(7-azabenzotriazol-1-yl)uronium hexafluorophosphate (45 mg, 0.117 mmol) were dissolved in N,N-dimethylformamide. N,N-Diisopropylethylamine (47 µL, 0.270 mmol) was added to the mixture. The amber colored scintillation vial was flushed with argon and allowed to stir 3 days at room temperature. Material was then purified silica gel chromatography using a dichloromethane/methanol gradient. Pooled fractions and concentrated to yield DSPE-PEG2000-VA as a yellow oil (245 mg, 89%). Verified product by NMR. $^1$H NMR (400 MHz), $\delta_H$: 6.86 (dd, 1H), 6.25 (m, 1H), 6.09-6.21 (dd, 4H), 5.71 (s, 1H), 5.1-5.2 (m, 1H), 4.3-4.4 (d, 1H), 4.1-4.2 (m, 3H), 3.85-4.0 (m, 4H), 3.8 (t, 1H), 3.5-3.75 (m, ~180H), 3.4-3.5 (m, 8H), 3.3 (m, 2H), 2.35 (s, 3H), 2.26 (m, 4H), 1.70 (s, 3H), 1.55-1.65 (m, 6H), 1.47 (m, 2H), 1.23 (s, ~60H), 1.01 (s, 6H), 0.85 (t, 6H).

Example 51: diVA-PEG-diVA, Referred to Herein as "DiVA"

Figure 34B:
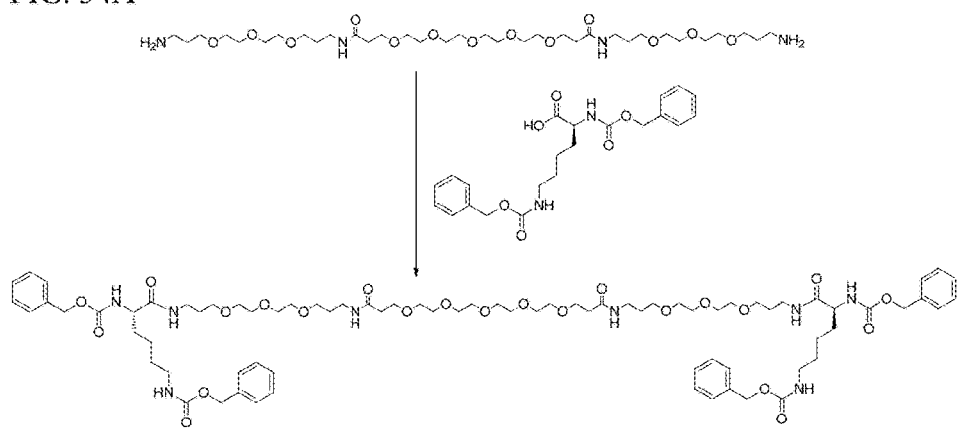
Figure 34C:
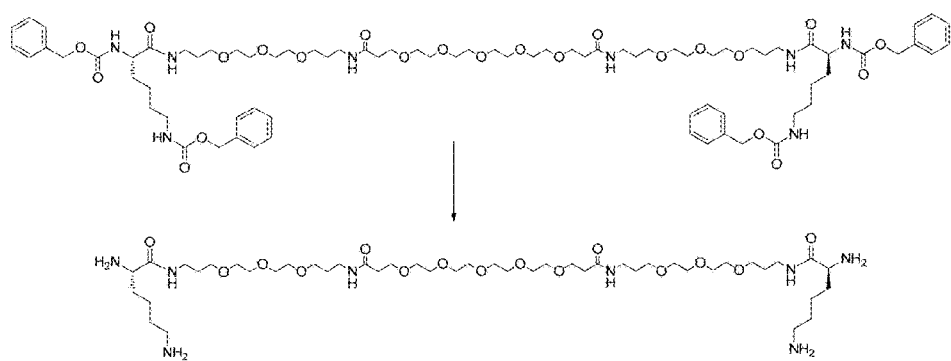

Preparation of DiVA: N1,N19-bis((S,23E,25E,27E,29E)-16-((2E,4E,6E,8E)-3,7-dimethyl-9-(2,6,6-trimethylcyclohex-1-en-1-yl)nona-2,4,6,8-tetraenamido)-24,28-dimethyl-15,22-dioxo-30-(2,6,6-trimethylcyclohex-1-en-1-yl)-4,7,10-trioxa-14,21-diazatriaconta-23,25,27,29-tetraen-1-yl)-4,7,10,13,16-pentaoxanonadecane-1,19-diamide (FIG. 34A).
Preparation of tetrabenzyl ((5S,57S)-6,22,40,56-tetraoxo-11,14,17,25,28,31,34,37, 45,48,51-undecaoxa-7,21,41,55-tetraazahenhexacontane-1,5,57,61-tetrayl) tetracarbamate, Z-DiVA-PEG-DiVA-IN (FIG. 34B).
A 1 L reaction flask cooled to 5-10° C. was purged with nitrogen and charged with dichloromethane (300 mL), d-PEG-11-diamine (Quanta lot EK1-A-1100-010, 50.0 g, 0.067 mol), Z-(L)-Lys(Z)-OH (61.5 g, 0.15 mol), and HOBt hydrate (22.5 g, 0.15 mol). 4-Methylmorpholine (4-MMP) (15.0 g, 0.15 mol) was added to the suspension and a light exothermic reaction was observed. A suspension of EDC hydrochloride (43.5 g, 0.23 mol) and 4-MMP (20.0 g, 0.20 mol) in dichloromethane (150 mL) was added over a period of 30 minutes, and moderate cooling was required in order to maintain a temperature of 20-23° C. The slightly turbid solution was stirred for 12 hours at ambient temperature, and HPLC indicates completion of reaction. Deionized water (300 mL) was added and after having stirred for 10 minutes, a quick phase separation was observed. The aqueous phase was extracted with dichloromethane (150 mL)—with a somewhat slower phase separation. The combined organic extracts are washed with 6% sodium bicarbonate (300 mL) and dried with magnesium sulphate (24 g). Evaporation from a 40-45° C. water bath under reduced pressure gives 132 g of crude product. A solution of crude product (131 g) in 8% methanol in ethyl acetate in loaded onto a column of silica gel 60 (40-63µ), packed with 8% methanol in ethyl acetate. The column was eluted with 8% methanol in ethyl acetate (7.5 L). The fractions containing sufficiently pure product (5.00-7.25 L) was evaporated from a 45° C. water bath under reduced pressure and 83.6 g of purified product. A solution of purified product (83.6 g) in dichloromethane (200 mL) was loaded onto a column of DOWEX® 650 C (H$^+$) (200 g), which has been washed with dichloromethane (250 mL). The column was eluted with dichloromethane (200 mL). The combined product containing fractions (300-400 mL) were dried with magnesium sulphate (14 g) and evaporated from a 45° C. water bath under reduced pressure to yield tetrabenzyl ((5S,57S)-6,22,40,56-tetraoxo-11,14,17,25,28,31,34,37,45,48,51-undecaoxa-7,21,41,55-tetraazahenhexacontane-1,5,57,61-tetrayl)tetracarbamate, referred to herein as Z-DiVA-PEG-DiVA-IN (77.9 g, HPLC purity 94.1%).
Preparation of Intermediate 2: N1,N19-bis((S)-16,20-diamino-15-oxo-4,7,10-trioxa-14-azaicosyl)-4,7,10,13,16- pentaoxanonadecane-1,19-diamide, referred to herein as DiVA-PEG-DiVA-IN (FIG. 34C).

A 1 L reaction flask was purged with nitrogen and charged with methanol (600 mL) and Z-DiVA-PEG-DiVA-IN (92.9, 60.5 mmol). The mixture was stirred under nitrogen until a solution was obtained. The catalyst, 10% Pd/C/50% water (Aldrich, 10 g) was added. The mixture was evacuated, and then the pressure was equalized by nitrogen. The mixture was evacuated, and then the pressure was equalized by hydrogen. Ensuring a steady, low flow of hydrogen over the reaction mixture, the stirrer was started. Hydrogenation was continued in a flow of hydrogen for one hour. The system was then closed, and hydrogenation was continued at −0.1 bar for one hour. The mixture was evacuated and then re-pressurized to −0.1 bar with hydrogen. After another hour of hydrogenation, the mixture was evacuated and then re-pressurized to 0.1 bar with hydrogen. Stirring under hydrogen was continued for 15 hours after which time no starting material could be detected by HPLC. The mixture was evacuated, and then the pressure was equalized by nitrogen. The mixture was evacuated, and then the pressure was equalized by nitrogen. The reaction mixture was then filtered on a pad of CELITE® 545. The filter cake was washed with methanol (100 mL). The combined filtrate was concentrated, finally at 45° C. and at a pressure of less than 50 mbar. Toluene (100 mL) was added and the resulting mixture was again concentrated finally at 45° C. and at a pressure of less than 40 mbar to yield N1,N19-bis((S)-16,20-diamino-15-oxo-4,7,10-trioxa-14-azaicosyl)-4,7,10,13,16-pentaoxanonadecane-1,19-diamide, also referred to herein as DiVA-PEG-DiVA-IN (63.4 g), as an oil that solidifies upon standing.

Figure 34D:
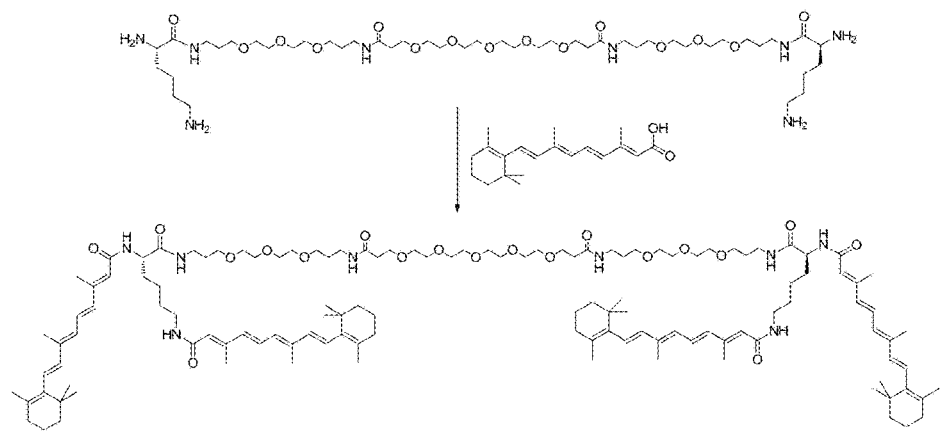
FIG. 34D shows preparation of DiVA-PEG-DiVA.

Preparation of DiVA-PEG-DiVA: N1,N19-bis((S,23E,25E,27E,29E)-16-((2E,4E,6E,8E)-3,7-dimethyl-9-(2,6,6-trimethylcyclohex-1-en-1-yl)nona-2,4,6,8-tetraenamido)-24,28-dimethyl-15,22-dioxo-30-(2,6,6-tri-methylcyclohex-1-en-1-yl)-4,7,10-trioxa-14,21-diazatriaconta-23,25,27,29-tetraen-1-yl)-4,7,10,13,16-pentaoxanonadecane-1,19-diamide (FIG. 34D).

A 2 L reactor was filled with argon and charged with dichloromethane (500 mL), DiVA-PEG-DiVA-IN (52.3 g, 52.3 mmol), retinoic acid (70.6 g, 235 mmol) and 4-N,N-dimethylaminopyridine (2.6 g, 21.3 mmol). The mixture was stirred under argon until dissolved (~20 minutes). Keeping the temperature of the reaction at 10-20° C., 1-ethyl-3-(3-dimethylaminopropyl) carbodiimide) (EDCI) (70.6 g, 369 mmol) was added portion wise over a period of 10-15 minutes (the reaction was slightly exothermic for the first 30-60 minutes). The reactor was covered with aluminium foil and the mixture was stirred at 18-21° C. for 15-20 hours. Butylated hydroxytoluene (BHT) (25 mg) was added and the reaction mixture was then poured onto aqueous 6% sodium hydrogen carbonate (500 mL) while keeping an argon atmosphere over the mixture. The organic phase was separated. The aqueous phase was washed with dichloromethane (50 mL). The combined organic phase was dried with of magnesium sulphate (150 g) under inert atmosphere and protected from light. The drying agent was filtered off (pressure filter preferred) and the filter cake was washed with dichloromethane (500 mL). The filtrate was concentrated by evaporation at reduced pressure using a water bath of 35-40° C. The oily residue was added toluene (150 mL) and evaporated again to yield a semi-solid residue of 210 g. This residue was dissolved in dichloromethane (250 mL) and applied onto a column prepared from silica gel 60 (1.6 kg) and 0.5% methanol in dichloromethane) (4 L). The column was eluted with dichloromethane (7.2 L), 2), 3% methanol in dichloromethane (13 L), 5% methanol in dichloromethane (13 L), 10% methanol in dichloromethane (18 L). One 10 L fraction was taken, and then 2.5 L fractions were taken. The fractions, protected from light were sampled, flushed with argon and sealed. The fractions taken were analyzed by TLC (10% methanol in dichloromethane, UV). Fractions holding DiVA-PEG-DiVA were further analyzed by HPLC. Five fractions<85% pure (gave 32 g of evaporation residue) were re-purified in the same manner, using only 25% of the original amounts of silica gel and solvents. The fractions>85% pure by HPLC were combined and evaporated at reduced pressure, using a water bath of 35-40° C. The evaporation residue (120 g) was re-dissolved in dichloromethane (1.5 L) and slowly passed (approximately 1 hour) through a column prepared from ion exchanger Dowex 650C, H+ form (107 g). The column was then washed with dichloromethane (1 L). The combined eluate (3277.4 g) was mixed well and a sample (25 mL, 33.33 g) was evaporated, finally at room temperature and a pressure of <0.1 mBar to afford 0.83 g of a foam. From this figure the total amount of solid material was thus calculated to a yield of 80.8 g (72.5%). The remaining 3.24 kg of solution was concentrated to 423 g. 266 g of this solution was concentrated further to yield a syrup and then re-dissolved in abs. ethanol (200 mL). Evaporation at reduced pressure, using a water bath of 35-40° C., was continued to yield a final ethanol solution of 94.8 g holding 50.8 g (53.6% w/w) of N1,N19-bis((S,23E,25E,27E,29E)-16-((2E,4E,6E,8E)-3,7-dimethyl-9-(2,6,6-trimethylcyclohex-1-en-1-yl)nona-2,4,6,8-tetraenamido)-24,28-dimethyl-15,22-dioxo-30-(2,6,6-trimethylcyclohex-1-en-1-yl)-4,7,10-trioxa-14,21-diazatriaconta-23,25,27,29-tetraen-1-yl)-4,7,10,13,16-pentaoxanonadecane-1,19-diamide, referred to herein as DiVA-PEG-DiVA, referred to herein as "DiVA". Characterized by NMR and QTOF. $^1$H NMR (400 MHz), $\delta_H$: 7.07 (t, 2H), 7.01 (t, 2H), 6.87-6.91 (m, 4.0H), 6.20-6.24 (m, 10H), 6.10-6.13 (m, 8H), 5.79 (s, 2H), 5.71 (s, 2H), 4.4 (q, 2H), 3.70 (t, 6H), 3.55-3.65 (m, ~34H), 3.59 (t, 6H), 3.4 (m, 2H), 3.25-3.33 (m, 10H), 3.16 (m, 2H), 2.44 (t, 4H), 2.33 (s, 12H), 1.97-2.01 (m, 12H), 1.96 (s, 6H), 1.7-1.9 (m, 12H), 1.69 (s, 12H), 1.5-1.65 (m, 12H), 1.35-1.5 (m, 24H), 1.01 (s, 24H). QTOF MS ESI+: m/z 2128 (M+H$^+$).

Example 52: DOPE-VA

Figure 35:
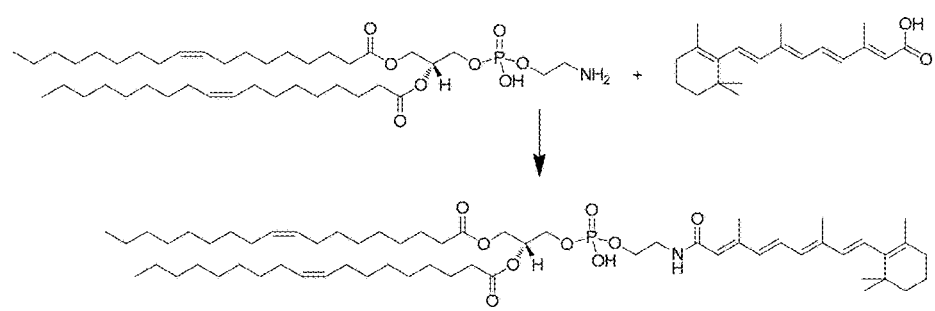
FIG. 35 shows preparation of DOPE-VA.

Preparation of DOPE-VA: (Z)-(2R)-3-(((2-((2E,4E,6E,8E)-3,7-dimethyl-9-(2,6,6-trimethylcyclohex-1-en-1-yl)nona-2,4,6,8-tetraenamido)ethoxy)(hydroxy)phosphoryl)oxy)propane-1,2-diyl dioleate (FIG. 35).

To a solution of retinoic acid (250 mg, 0.83 mmol) in diethyl ether stirring (20 mL) at −78° C., a solution of (diethylamino)sulfur trifluoride (130 µl, 0.90 mmol) in cold ether (20 mL) was added through a syringe. The reaction mixture was taken out of the cold bath and the stirring was continued at room temperature for an additional 2 hr. At the end, the solvent was removed by rotary evaporation. The residue was redissolved chloroform (50 mL) in the presence of solid Na$_2$CO$_3$ (50 mg). To this solution was added 1,2-dioleoyl-sn-glycero-3-phosphoethanolamine (600 mg, 0.81 mmol) and the reaction mixture was stirred at room temperature for an additional 24 hrs. The solvent was removed by rotary evaporation. The residue was purified by silica gel chromatography with a dichloromethane/methanol gradient to yield Z)-(2R)-3-(((2-((2E,4E,6E,8E)-3,7-dimethyl-9-(2,6,6-trimethylcyclohex-1-en-1-yl)nona-2,4,6,8-tetraenamido)ethoxy)(hydroxy)phosphoryl)oxy)propane-1,2-diyl dioleate (240 mg, 28%). 1H NMR (400 MHz, CDCl$_3$)

δ 0.87 (t, 6H, CH$_3$), 1.01 (s, 6H, CH$_3$) 1.20-1.40 (m, 40H, CH$_2$), 1.40-1.60 (m, 8H, CH$_2$), 1.70 (s, 3H, CH$_3$—C=C), 1.80-2.10 (m, 8H), 2.32 (m, 4H, CH$_2$C(=O)), 3.50 (m, 2H), 3.92-4.18 (m, 5H), 4.35 (m, 2H), 5.20 (m, 1H, NHC(=O)), 5.31 (m, 4H, CH=CH), 5.80-6.90 (m, 6H, CH=CH).

Example 53: DC-VA

Figure 36:
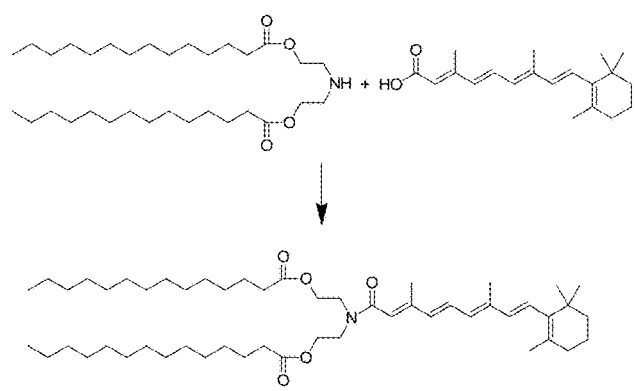
FIG. 36 shows preparation of DC-VA.

Preparation of DC-VA: (((2E,4E,6E,8E)-3,7-dimethyl-9-(2,6,6-trimethylcyclohex-1-en-1-yl)nona-2,4,6,8-tetraenoyl)azanediyl)bis(ethane-2,1-diyl) ditetradecanoate (FIG. 36).

To a solution of retinoic acid (600 mg, 2.0 mmol) in diethyl ether (25 mL) stirring at −78° C., a solution of (diethylamino)sulfur trifluoride (0.3 ml, 2.1 mmol) in 5 mL of cold ether was added through a syringe. The reaction mixture was taken out of the cold bath and the stirring was continued at room temperature for an additional 1 hr. After the solvent was removed by rotary evaporation, the residue was re-dissolved in dichloromethane (20 mL) in the presence of 2 solid Na$_2$CO$_3$ (25 mg). To this solution was added the azanediylbis(ethane-2,1-diyl) ditetradecanoate (1.05 g, 2.0 mmol), and the reaction mixture was stirred at room temperature for an additional 24 hrs. The reaction mixture was diluted with dichloromethane (50 mL) and was dried over MgSO$_4$. After the solvent was removed by rotary evaporation, the residue was purified by silica gel chromatography with a dichloromethane/methanol gradient to yield (((2E,4E,6E,8E)-3,7-dimethyl-9-(2,6,6-trimethylcyclohex-1-en-1-yl)nona-2,4,6,8-tetraenoyl)azanediyl)bis(ethane-2,1-diyl) ditetradecanoate (800 mg, 50%). 1H NMR (400 MHz, CDCl$_3$) δ 0.87 (t, 6H, CH$_3$), 1.02 (s, 6H, CH$_3$) 1.20-1.40 (m, 40H, CH$_2$), 1.40-1.60 (m, 8H, CH$_2$), 1.70 (s, 3H, CH$_3$—C=C), 1.97 (s, 3H, CH$_3$—C=C), 2.05 (m, 2H, CH$_2$), 2.15 (s, 3H, CH$_3$—C=C), 2.32 (m, 4H, CH$_2$C(=O)), 3.67 (m, 4H, NCH$_2$CH$_2$O), 4.15-4.30 (m, 4H, NCH$_2$CH$_2$O), 5.80-6.90 (m, 6H, CH=CH).

Example 54: DC-6-VA

Figure 37A:
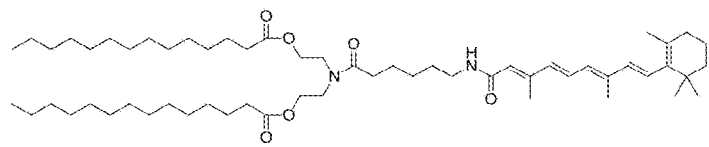
FIG. 37A shows the structure of DC-6-VA.

Preparation of DC-6-VA: ((6-((2E,4E,6E,8E)-3,7-dimethyl-9-(2,6,6-trimethylcyclohex-1-en-1-yl)nona-2,4,6,8-tetraenamido)hexanoyl)azanediyl)bis(ethane-2,1-diyl) ditetradecanoate (FIG. 37A).

Figure 37B:
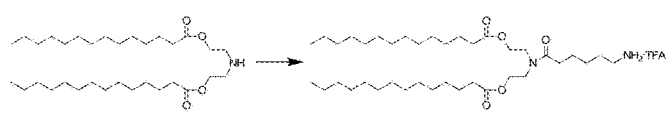
FIG. 37B shows preparation ((6-aminohexanoyl)azanediyl)bis(ethane-2,1-diyl) ditetradecanoate TFA salt.

Preparation of ((6-aminohexanoyl)azanediyl)bis(ethane-2,1-diyl) ditetradecanoate TFA salt (FIG. 37B). A mixture of azanediylbis(ethane-2,1-diyl) ditetradecanoate (2.5 g, 4.8 mmol), Boc-amino caproic acid (1.3 g, 5.6 mmol), N,N'-dicyclohexylcarbodiimide (1.3 g, 6.3 mmol) and N,N-diisopropylethylamine (2.6 mL, 0.015 mmol) were dissolved in pyridine (40 mL). The solution was stirred at 60° C. for 12 hours. The mixture was diluted with dichloromethane (50 mL) and washed with saline (3×50 mL). After being concentrated by rotary evaporation, the residue was treated with trifluoroacetic acid/dichloromethane (100 mL, 1:1). The mixture was concentrated and was re-dissolved in dichloromethane (50 mL) and washed with saline (3×50 mL). The organic layer was isolated and concentrated to yield ((6-aminohexanoyl)azanediyl)bis(ethane-2,1-diyl) ditetradecanoate TFA salt (1.5 g, 33%).

Figure 37C:
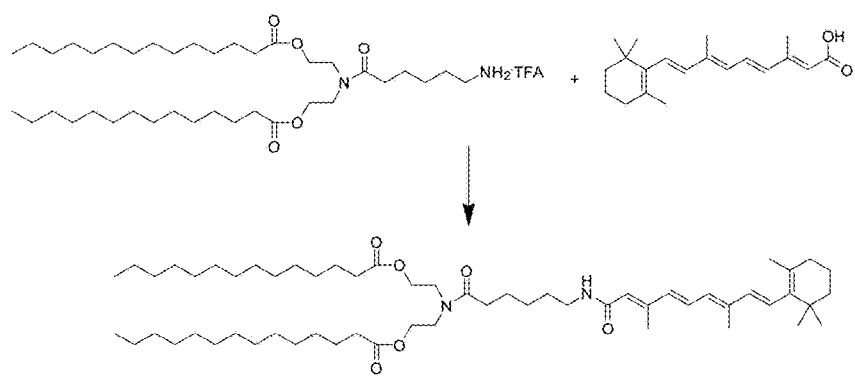
FIG. 37C shows preparation of DC-6-VA.

Preparation of DC-6-VA: ((6-((2E,4E,6E,8E)-3,7-dimethyl-9-(2,6,6-trimethylcyclohex-1-en-1-yl)nona-2,4,6,8-tetraenamido)hexanoyl)azanediyl)bis(ethane-2,1-diyl) (FIG. 37C).

To a solution of retinoic acid (800 mg, 2.67 mmol) in diethyl ether (40 mL) stirring at −78° C., a solution of (diethylamino)sulfur trifluoride (0.4 mL, 22.80 mmol) in cold ether (7 mL) was added through a syringe. The reaction mixture was taken out of the cold bath and the stirring was continued at room temperature for an additional 1 hour. After the solvent was removed by rotary evaporation, the residue was re-dissolved in dichloromethane (25 mL) in the presence of solid Na$_2$CO$_3$ (40 mg). To this solution was added the ((6-aminohexanoyl)azanediyl)bis(ethane-2,1-diyl) ditetradecanoate TFA salt (1.5 g, 1.6 mmol) and the reaction mixture was stirred at room temperature for an additional 24 hours The reaction mixture was diluted with dichloromethane (50 mL) and dried over MgSO$_4$. After the solvent was removed by rotary evaporation, the residue was purified by column chromatography using 5% methanol/dichloromethane as eluent to yield ((6-((2E,4E,6E,8E)-3,7-dimethyl-9-(2,6,6-trimethylcyclohex-1-en-1-yl)nona-2,4,6,8-tetraenamido)hexanoyl)azanediyl)bis(ethane-2,1-diyl) ditetradecanoate (360 mg, 24%). 1H NMR (400 MHz, CDCl$_3$) δ 0.87 (t, 6H, CH$_3$), 1.02 (s, 6H, CH$_3$) 1.20-1.40 (m, 42H, CH$_2$), 1.40-1.60 (m, 12H, CH$_2$), 1.70 (s, 3H, CH$_3$—C=C), 1.97 (s, 3H, CH$_3$—C=C), 2.05 (m, 2H, CH$_2$), 2.15 (s, 3H, CH$_3$—C=C), 2.32 (m, 6H, CH$_2$C(=O)), 3.20 (m, 2H, CH$_2$NHC(=O)), 3.56 (m, 4H, NCH$_2$CH$_2$O), 4.15-4.30 (m, 4H, NCH$_2$CH$_2$O), 5.10 (m, 1H), 5.80-6.90 (m, 6H, CH=CH).

Example 55: In Vitro Evaluation of VA-siRNA-Liposome Formulations for Knockdown Efficiency in LX-2 Cell Line and Rat Primary Hepatic Stellate Cells (pHSCs)

LX2 cells were grown in DMEM (Invitrogen) supplemented with 10% fetal bovine serum (Invitrogen) at 37° C. in the incubator with 5% CO$_2$. Cells were trypsinized using TryPLExpress solution (Invitrogen) for 3 minutes at 37° C. in the incubator. The cell concentration was determined by cell counting in hemocytometer and 3000 cells/well were seeded into the 96-well plates. The cells were grown for 24 h prior to transfection.

Rat primary hepatic stellate cells (pHSCs) were isolated from Sprague-Dawley rats according to the previously published method (Nat. Biotechnol. 2008, 26(4):431-42). pHSCs were grown in DMEM supplemented with 10% fetal bovine serum. Cells were grown up to two passages after isolation before using them for in vitro screening. Cells were seeded at the cell density of 1000 cells/well in 96-well plates and grown for 48 hours before using them for transfection.

Transfection with VA-siRNA-Liposome formulations. The transfection method is the same for LX-2 and pHSC cells. The VA-siRNA-Liposome or VA-siRNA-Lipoplex formulations were mixed with growth medium at desired concentrations. 100 µl of the mixture was added to the cells in 96-well plate and cells were incubated for 30 min at 37° C. in the incubator with 5% CO$_2$. After 30 min, medium was replaced with fresh growth medium after. After 48 h of transfection, cells were processed using Cell-to-Ct lysis reagents (Applied Biosystems) according to the manufacturer's instructions.

Quantitatve (q) RT-PCR for measuring HSP47 mRNA expression. HSP47 and GAPDH TAQMAN® assays and One-Step RT-PCR master mix were purchased from Applied Biosystems. Each PCR reaction contained the following composition: One-step RT-PCR mix 5 µl, TAQMAN® RT enzyme mix 0.25 µl, TAQMAN® gene expression assay probe (HSP47) 0.25 µl, TAQMAN® gene expression assay probe (GAPDH) 0.5 µl, RNase-free water 3.25 µl, Cell lysate 0.75 µl, total volume of 10 µl. GAPDH was used as endogenous control for the relative quantification of HSP47 mRNA levels. Quantitative RT-PCR was performed in VIIA™ 7 real time PCR system (Applied Biosciences) using an in-built Relative Quantification method. All values were normalized to the average HSP47 expression of the mock transfected cells and expressed as percentage of HSP47 expression compared to mock.

The siRNA referred to in the formulation protocols are double stranded siRNA sequence with 21-mer targeting HSP47/gp46 wherein HSP47 (mouse) and gp46 (rat) are homologs—the same gene in different species:

Rat HSP47-C double stranded siRNA used for in vitro assay (rat pHSCs)

```
Sense (5'->3')
                                      (SEQ. ID NO. 5)
GGACAGGCCUCUACAACUAUU Antisense (3'->5')
                                      (SEQ. ID NO. 6)
UUCCUGUCCGGAGAUGUUGAU.
```

Cationic Lipid Stock Preparation. Stock solutions of cationic lipids were prepared by combining the cationic lipid with DOPE, cholesterol, and diVA-PEG-DiVA in ethanol at concentrations of 6.0, 5.1 and 2.7 and 2.4 mg/mL respectively. If needed, solutions were warmed up to about 50° C. to facilitate the dissolution of the cationic lipids into solution.

Empty Liposome Preparation. A cationic lipid stock solution was injected into a rapidly stirring aqueous mixture of 9% sucrose at 40±1° C. through injection needle(s) at 1.5 mL/min per injection port. The cationic lipid stock solution to the aqueous solution ratio (v/v) is fixed at 35:65. Upon mixing, empty vesicles formed spontaneously. The resulting vesicles were then allowed to equilibrate at 40° C. for 10 minutes before the ethanol content was reduced to ~12%.

Lipoplex Preparation. Lipoplex was prepared in a same manner as described in Example 37 using the empty vesicle prepared according to the above.

Formation of non-diVA siRNA containing liposomes. Cationic lipid, DOPE, cholesterol, and PEG conjugated lipids (e.g., PEG-Lipid) were solubilized in absolute ethanol (200 proof) at a molar ratio of 50:10:38:2. The siRNA was solubilized in 50 mM citrate buffer, and the temperature was adjusted to 35-40° C. The ethanol/lipid mixture was then added to the siRNA-containing buffer while stirring to spontaneously form siRNA loaded liposomes. Lipids were combined with siRNA to reach a final total lipid to siRNA ratio of 15:1 (wt:wt) The range can be 5:1 to 15:1, preferably 7:1 to 15:1. The siRNA loaded liposomes were diafiltered against 10× volumes of PBS (pH 7.2) to remove ethanol and exchange the buffer. Final product was filtered through 0.22 µm, sterilizing grade, PES filter for bioburden reduction. This process yielded liposomes with a mean particle diameter of 50-100 nm, PDI<0.2, >85% entrapment efficiency.

Formation of siRNA containing liposomes co-solubilized with diVA. siRNA-diVA-Liposome formulations were prepared using the method described above. diVA-PEG-diVA was co-solubilized in absolute ethanol with the other lipids (cationic lipid, DOPE, cholesterol, and PEG-conjugated lipids at a ratio of 50:10:38:2) prior to addition to the siRNA containing buffer. Molar content of diVA-PEG-diVA ranged from 0.1 to 5 molar ratio. This process yielded liposomes with a mean particle diameter of 50-100 nm, PDI<0.2, >85% entrapment efficiency.

Formation of siRNA containing liposomes with cationic lipids. siRNA-diVA-Liposome formulations and siRNA-Liposome formulations were prepared using the method described above. Cationic lipid can be, for example, DODC, HEDC, HEDODC, DC-6-14, or any combination of these cationic lipids.

Formation of siRNA containing liposomes decorated with diVA. siRNA-Liposome formulations were prepared using the method described above and diluted to a siRNA concentration of 0.5 mg/mL in PBS. Cationic lipid can be DODC, HEDC, HEDODC, DC-6-14, or any combination of these cationic lipids. diVA-PEG-diVA was dissolved in absolute ethanol (200 proof) to a final concentration ranging from 10 to 50 mg/mL. An appropriate amount of ethanol solution was added to the siRNA-Liposome solution to yield a final molar percentage between 2 to 10 mol %. Solution was plunged up and down repeatedly with a pipette to mix. diVA-PEG-diVA concentration and ethanol addition volume were adjusted to keep the addition volume>1.0 µL and the final ethanol concentration<3% (vol/vol). Decorated liposomes were then gently shaken at ambient temperature for 1 hr on an orbital shaker prior to in vitro or in vivo evaluation.

Figure 38:
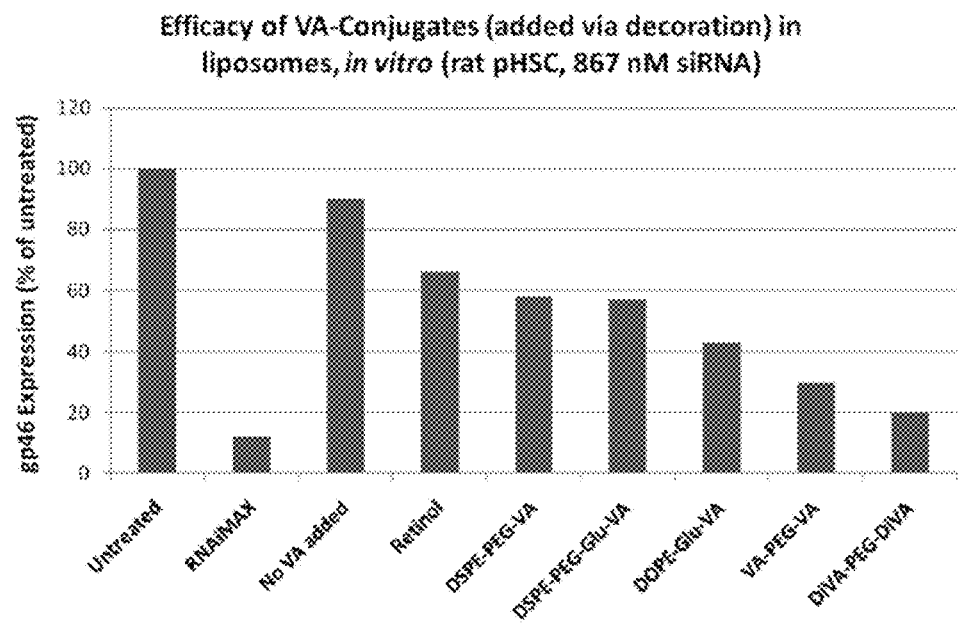
FIG. 38 shows that VA-conjugate addition to liposomes via decoration enhances siRNA activity.

FIG. 38 shows that addition of the VA-conjugate to liposomes via decoration improved the knockdown efficacy of siRNA, enhancing siRNA activity. The dose for all samples was 867 nM siRNA HSP47-C. The results showed that in every instance where a VA-conjugate was added to liposomes, siRNA activity was enhanced compared to liposomes without a retinoid and compared to liposomes decorated with free (non-conjugated) retinol. RNAiMAX™ was a commercial transfection reagent.

Figure 39:
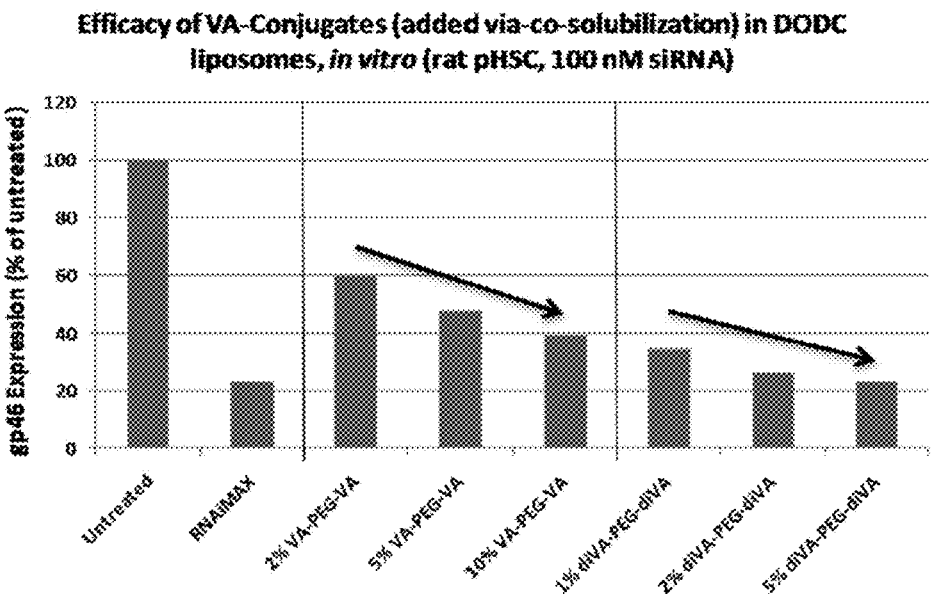
FIG. 39 shows that VA-conjugate addition to liposomes via co-solubilization enhances siRNA activity.

FIG. 39 shows that addition of VA-conjugates to liposomes via co-solubilization improves knockdown efficacy of siRNA. These were DODC containing liposomes with VA-conjugates added via co-solubilization. The formulation is 50:10:38:2:X, where X=1 to 10 (DODC:DOPE:cholesterol: PEG-Lipid:VA-conjugate, mole ratio). The concentration in every instance was 100 nM siRNA HSP47-C. The results show that addition of VA-conjugates to liposomes via cosolubilization enhances siRNA activity.

Figure 40:
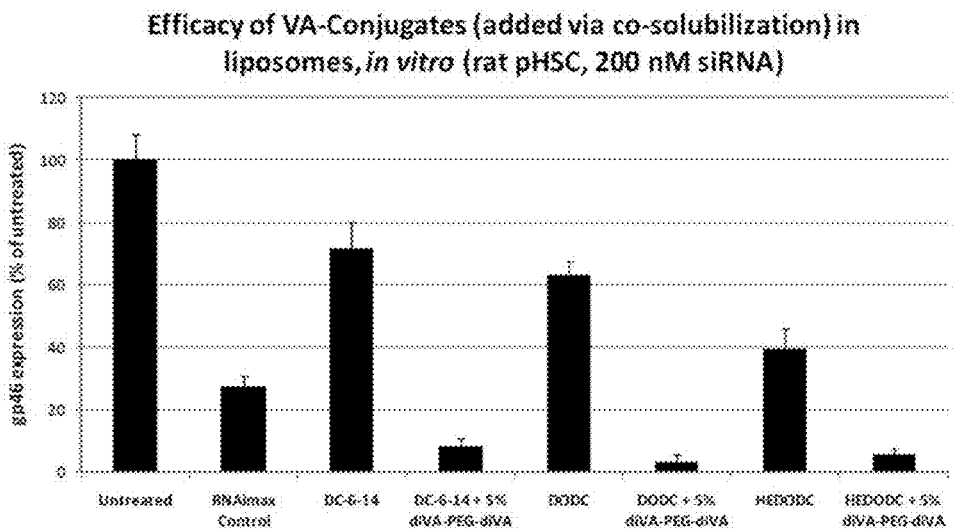
FIG. 40 shows that VA-conjugate addition to liposomes via co-solubilization enhances siRNA activity.

FIG. 40 shows that addition of VA-conjugate to liposomes via co-solubilization dramatically improves the knockdown efficacy of siRNA. Results include three different liposomes, DC-6-14, DODC, HEDODC with VA-conjugates added via co-solubilization. The formulation is the same for all, 50:10: 38:2, cationic lipid:DOPE:cholesterol:Peg-Lipid, with only the cationic lipid varying. The concentration of siRNA is 200 nM siRNA HSP47-C is the same for all. The results show in that VA-conjugate addition to liposomes having different cationic lipids significantly enhanced siRNA activity, when prepared by co-solubilization.

Figure 41:
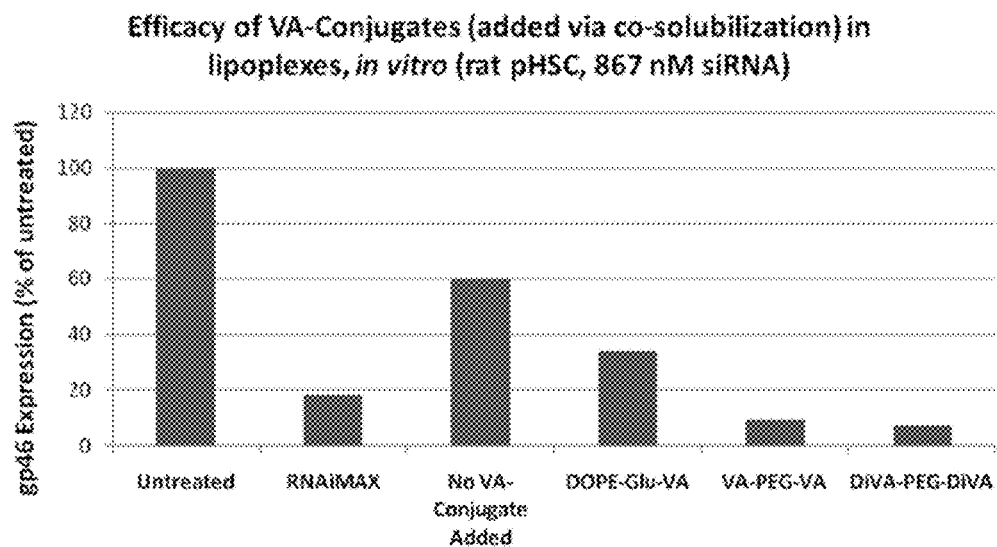
FIG. 41 shows that VA-conjugate addition to lipoplexes via co-solubilization enhance siRNA activity.

FIG. 41 shows that addition of VA-conjugates to lipoplexes having DC-6-14 cationic lipid via co-solubilization, and siRNA coating the exterior of the liposome enhances siRNA activity. The formulation is a 40% lipoplex formulation, 40:30:30, DC-6-14:DOPE:cholesterol. The concentration for all samples is 867 nM siRNA HSP47-C. The results show that VA-conjugate addition to lipoplexes via co-solubilization enhance siRNA activity.

Figure 42:
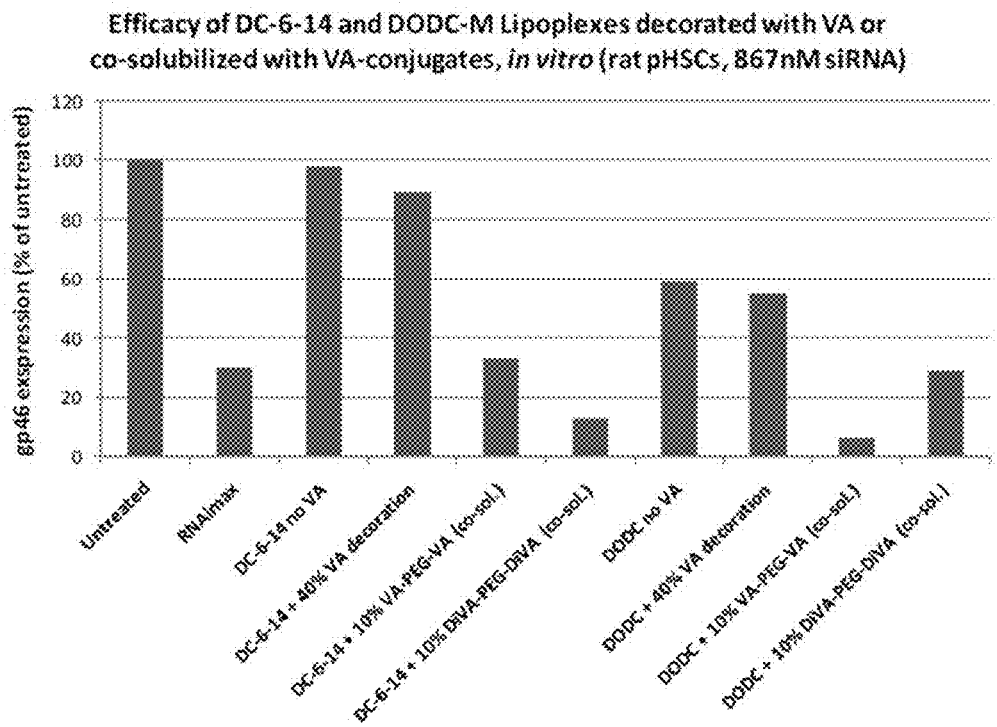
FIG. 42 shows that VA-conjugate addition to lipoplexes via co-solubilization enhance siRNA activity.

FIG. 42 shows that addition of VA-conjugate to lipoplexes formed via co-solubilization compared to lipoplexes with VA-conjugate added via decoration. These results are from DC-6-14 and DODC lipoplexes. The formulation consists of 40:30:30, DC-6-14:DOPE:cholesterol. The concentration in each sample is 867 nM siRNA HSP47-C. VA-conjugate addition via co-solubilization significantly improves knockdown efficacy in vitro, relative to VA-conjugates added by decoration.

Example 56: In Vivo Experiments

Female C57Bl/6 retired breeder mice (Charles River) with a weight range of 24-30 grams were used. Animals were randomly distributed by weight into ten groups of ten animals each. All animal procedures were approved by Bio-Quant's IACUC and/or Attending Veterinarian as necessary and all animal welfare concerns were addressed and documented. Mice were anesthetized with Isoflurane and exsanguinated via the inferior vena cava.

Mouse HSP47-C double stranded siRNA used in formulations for in vivo assay (mouse CCl4 model)

```
Sense (5'->3')
                                  (SEQ. ID NO. 3)
GGACAGGCCUGUACAACUAUU Antisense (3'->5')
                                  (SEQ. ID NO. 4)
TTCCUGUCCGGACAUGUUGAU
```

Upregulation of heat shock protein 47 (HSP47) was induced via intraperitoneal injection of $CCl_4$ ($CCl_4$ in olive oil, 1:7 (vol/vol), 1 µL per gram body weight) given every other day for 7 days (day 0, 2, 4, 6). On day 3 mice were treated for 4 consecutive days (day 3, 4, 5, 6) with liposome or lipoplex formulations of described herein or PBS by IV injection into the tail vein. One group of ten mice (naïve) received neither $CCl_4$ treatment nor IV injection and served as the control group for normal HSP47 gene expression.

| Experimental Timeline | | | | | | | | |
|---|---|---|---|---|---|---|---|---|
| | Day | | | | | | | |
| | 0 | 1 | 2 | 3 | 4 | 5 | 6 | 7 |
| $CCl_4$ IP Injection | X | X | X | X | X | X | X | |
| Test Article IV Injection | | | | X | X | X | X | |
| Sample Collection (n = 10) | | | | | | | | X |

On day 7 and 24 hours after final IV injection, all remaining mice were sacrificed and the livers were perfused with PBS prior to collecting liver samples for PCR analysis. An approximate 150 mg sample from each mouse liver was collected and placed in 1.5 mL RNALATER® stabilization reagent (Qiagen) and stored at 2-8° C. until analysis. Liver samples were not collected from areas of clear and marked liver damage and/or necrosis.

Figure 43:
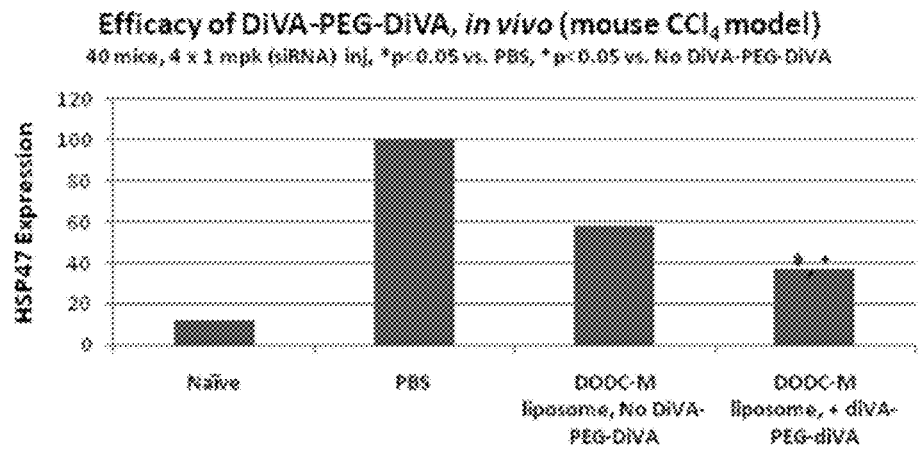
FIG. 43 shows in vivo efficacy in mouse, CCl$_4$ model.
Figure 44:
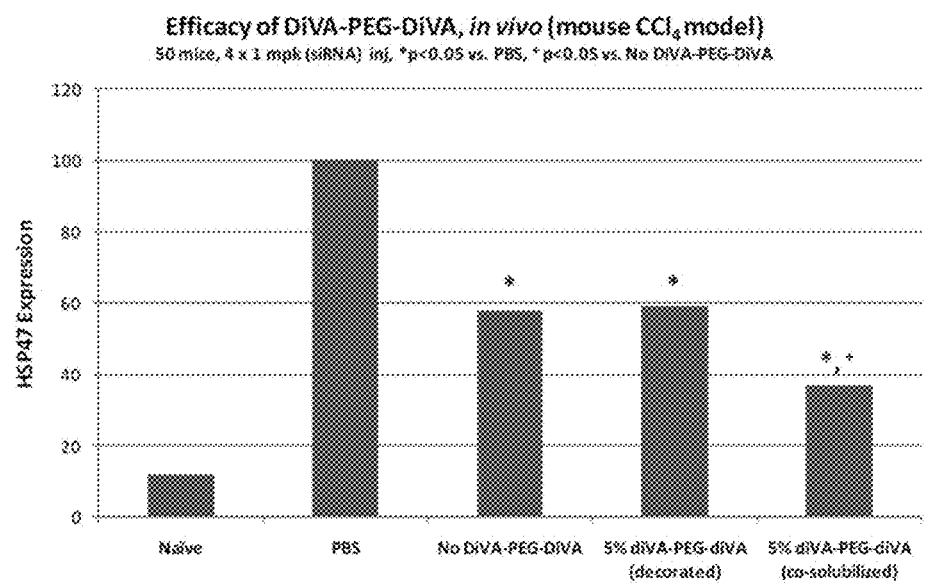
FIG. 44 shows in vivo efficacy of decorated vs. co-solubilized retinoid conjugates.

HSP47 expression was analyzed in a same manner as described in Example 37. The results are shown in FIGS. 43 and 44.

Example 57: Synthesis of satDiVA

Preparation of N1,N19-bis((16S)-16-(3,7-dimethyl-9-(2,6,6-trimethylcyclohex-1-en-1-yl)nonanamido)-24,28-dimethyl-15,22-dioxo-30-(2,6,6-trimethylcyclohex-1-en-1-yl)-4,7,10-trioxa-14,21-diazatriacontyl)-4,7,10,13,16-pentaoxanonadecane-1,19-diamide (satDIVA).

Figure 45A:
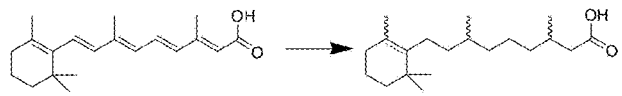
FIG. 45A shows preparation of 3,7-dimethyl-9-(2,6,6-trimethylcyclohex-1-en-1-yl)nonanoic acid.

Preparation of 3,7-dimethyl-9-(2,6,6-trimethylcyclohex-1-en-1-yl)nonanoic acid (FIG. 45A).

All-trans retinoic acid (2000 mg, 6.66 mmol) was dissolved in hexanes/IPA (3:1, 40 mL) with the aid of sonication. Material was placed in a Parr-shaker bottle and flushed with inert gas. 10% Pd/C (200 mg) was added and the vessel was once again flushed with inert gas. Material was placed on the Parr-Shaker for 12 hours with >70 psi hydrogen gas. The reaction mixture was then filtered through a pad of CELITE® and concentrated to yield 3,7-dimethyl-9-(2,6,6-trimethylcyclohex-1-en-1-yl)nonanoic acid (2 g).

Figure 45B:
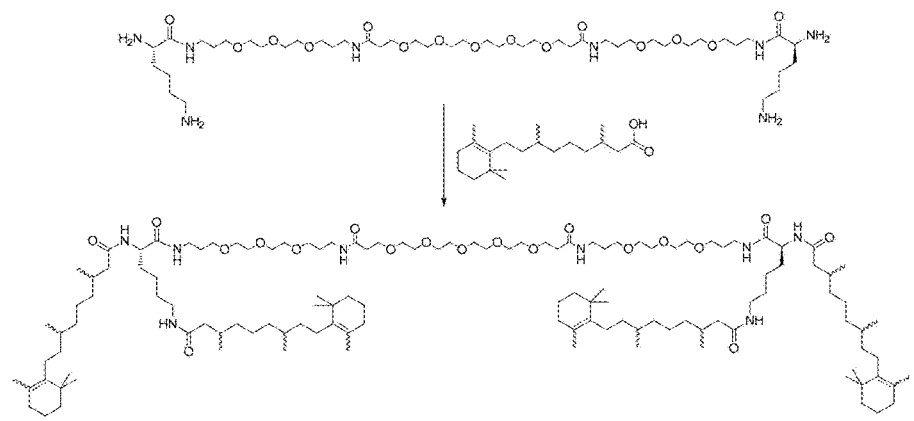
FIG. 45B shows preparation of satDIVA.

Preparation of satDIVA: N1,N19-bis((16S)-16-(3,7-dimethyl-9-(2,6,6-trimethylcyclohex-1-en-1-yl)nonanamido)-24,28-dimethyl-15,22-dioxo-30-(2,6,6-trimethylcyclohex-1-en-1-yl)-4,7,10-trioxa-14,21-diazatriacontyl)-4,7,10,13,16-pentaoxanonadecane-1,19-diamide (FIG. 45B).

N1,N19-bis((16S)-16-(3,7-dimethyl-9-(2,6,6-trimethylcyclohex-1-en-1-yl)nonanamido)-24,28-dimethyl-15,22-dioxo-30-(2,6,6-trimethylcyclohex-1-en-1-yl)-4,7,10-trioxa-14,21-diazatriacontyl)-4,7,10,13,16-pentaoxanonadecane-1,19-diamide (satDIVA) was prepared in similar fashion as diva-PEG-diVA from previously described N1,N19-bis((S)-16,20-diamino-15-oxo-4,7,10-trioxa-14-azaicosyl)-4,7,10,13,16-pentaoxanonadecane-1,19-diamide with the substitution of 3,7-dimethyl-9-(2,6,6-trimethylcyclohex-1-en-1-yl)nonanoic acid for all-trans retinoic acid. QTOF MS ESI+: m/z 2161, 2163, 2165 and 2167 (M+H+)

Example 58: Synthesis of simDiVA

Preparation of N1,N19-bis((S)-15,22-dioxo-30-(2,6,6-trimethylcyclohex-1-en-1-yl)-16-(9-(2,6,6-trimethylcyclohex-1-en-1-yl)nonanamido)-4,7,10-trioxa-14,21-diazatriacontyl)-4,7,10,13,16-pentaoxanonadecane-1,19-diamide (simDiVA).

Figure 46A:
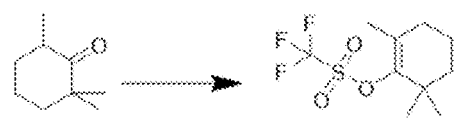
FIG. 46A shows preparation of 2,6,6-trimethylcyclohex-1-en-1-yl trifluoromethanesulfonate.

Preparation of 2,6,6-trimethylcyclohex-1-en-1-yl trifluoromethanesulfonate (FIG. 46A).

To a solution of 2,2,6-trimethylcyclohexanone in dry THF at −78° C. under nitrogen was added dropwise a 2 M lithium diisopropylamide solution. The mixture was stirred at −78° C. for 3 h. A solution of N-phenyl-bis(trifluoromethanesulfonimide) in THF was then added dropwise (at −78° C.). The reaction flask was packed in dry-ice and stirred for 12 hours. The stirring was continued at room temperature for 3 h under which time all material had dissolved. The reaction mixture was concentrated and the residue was added slowly to hexane (350 mL) under vigorous stirring. The solid material was removed by filtration and washed with hexane (2×50 mL). The filtrate was concentrated and more hexane (150 mL) was added. The solid material was removed by filtration and the filtrate was concentrated. The precipitation was repeated one more time after which the residue was purified by flash chromatography (silica, hexane) to give 2,6,6-trimethylcyclohex-1-en-1-yl trifluoromethanesulfonate as a colorless oil (23.2 g, 60% yield).

Figure 46B:
FIG. 46B shows preparation of 2: ethyl 9-(bromozincio)nonanoate.

Preparation of Intermediate 2: ethyl 9-(bromozincio)nonanoate (FIG. 46B).

In a dry reaction tube under nitrogen were charged zinc dust (3.70 g, 56.6 mmol), iodine (479 mg, 1.89 mmol) and dry DMA (20 mL). The mixture was stirred at room temperature until the color of iodine disappeared. Ethyl 9-bromononanoate was added, and the mixture was stirred at 80° C. for 4 hours and then at room temperature for 12 hours. (Completion of the zinc insertion reaction was checked by GCMS analysis of the hydrolyzed reaction mixture.) The reaction mixture was used without further treatment in the subsequent step. GCMS m/z 186 [M]+(ethyl nonanoate).

Figure 46C:
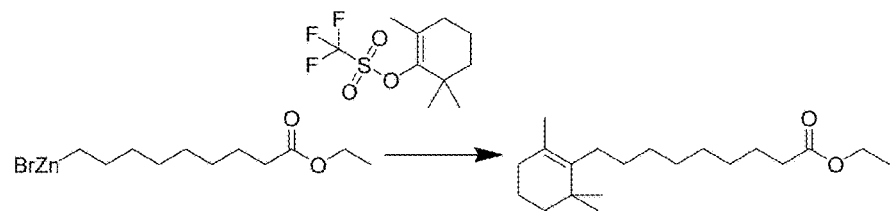
FIG. 46C shows preparation of ethyl 9-(2,6,6-trimethyl-cyclohex-1-en-1-yl)nonanoate.

Preparation of Intermediate 3: ethyl 9-(2,6,6-trimethylcyclohex-1-en-1-yl)nonanoate (FIG. 46C). To ethyl 9-(bromozincio)nonanoate (37.7 mmol) in dimethylacetamide under nitrogen was added 2,6,6-trimethylcyclohex-1-en-1-yl trifluoromethanesulfonate (10.8 g, 39.6 mmol) followed by tetrakis(triphenylphosphine)palladium(0) (872 mg, 0.754 mmol). The mixture was stirred at 95° C. for 2 hours. The reaction mixture was allowed to cool and was then poured into diethyl ether (100 mL). The upper layer was decanted and the lower layer was washed twice with diethyl ether (2×25 mL). The combined ether layers were washed with sat NH$_4$Cl and brine, dried (MgSO$_4$) and concentrated to give crude material (~12 g). The material was purified by flash chromatography (silica, 0 to 1.5% EtOAc in hexane). The obtained oil was stirred under vacuum for 8 hours in order to remove the side-product, ethyl nonanoate, and was then purified by a second flash chromatography (silica, 0 to 15% toluene in hexane). The fractions were analyzed by LCMS and GCMS. The purest fractions were collected and concentrated at a temperature below 25° C. to give ethyl 9-(2,6,6-trimethylcyclohex-1-en-1-yl)nonanoate as a colorless oil (6.16 g, 53% yield over two steps). LCMS ESI+m/z 309 [M+H]+; GCMS m/z 308 [M]+.

Figure 46D:
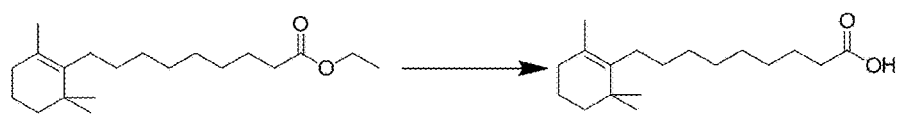
FIG. 46D shows preparation of 9-(2,6,6-trimethylcyclohex-1-en-1-yl)nonanoic acid.

Preparation of Intermediate 4: 9-(2,6,6-trimethylcyclohex-1-en-1-yl)nonanoic acid (FIG. 46D).

To ethyl 9-(2,6,6-trimethylcyclohex-1-en-1-yl)nonanoate (13.2 g, 42.9 mmol) in ethanol (80 mL) was added 4 M KOH (43 mL). The mixture was stirred at room temperature for 1.5 hours. Water (350 mL) was added and the solution was washed with tert-butyl methyl ether (2×100 mL). The SimVA, aqueous phase was cooled, acidified with 4 M HCl (~45 mL) and extracted with pentane (3×100 mL). The combined pentane extracts were washed with water (200 mL), dried (MgSO4), filtered, concentrated and dried under high vacuum. The material was redissolved in pentane (100 mL), concentrated and dried under high vacuum to give 9-(2,6,6-trimethylcyclohex-1-en-1-yl)nonanoic acid as a colorless oil (11.1 g, 92% yield). MS ESI-m/z 279 [M–H]–.

Figure 46E:
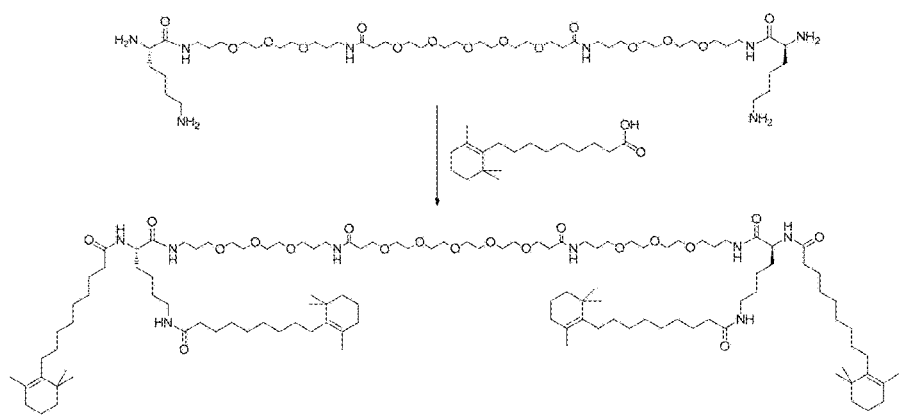
FIG. 46E shows preparation of simdiVA.

Preparation of simdiVA: N1,N19-bis((S)-15,22-dioxo-30-(2,6,6-trimethylcyclohex-1-en-1-yl)-16-(9-(2,6,6-trimethylcyclohex-1-en-1-yl)nonanamido)-4,7,10-trioxa-14,21-diazatriacontyl)-4,7,10,13,16-pentaoxanonadecane-1,19-diamide (FIG. 46E).

simDIVA was prepared in similar fashion as diVA from previously described N1,N19-bis((S)-16,20-diamino-15-oxo-4,7,10-trioxa-14-azaicosyl)-4,7,10,13,16-pentaoxanonadecane-1,19-diamide with the substitution of 9-(2,6,6-trimethylcyclohex-1-en-1-yl)nonanoic acid for all-trans retinoic acid. QTOF MS ESI+: m/z 2050 (M+H+)

Example 60: Synthesis of DiVA-PEG18

Preparation of (2E,2'E,2"E,4E,4'E,4"E,6E,6'E,6"E,8E,8'E,8"E)-N,N',N"-((5R,69R,76E,78E,80E,82E)-77,81-dimethyl-6,68,75-trioxo-83-(2,6,6-trimethylcyclohex-1-en-1-yl)-10,13,16,19,22,25,28,31,34,37,40,43,46,49,52,55,58,61,64-nonadecaoxa-7,67,74-triazatrioctaconta-76,78,80,82-tetraene-1,5,69-triyl)tris(3,7-dimethyl-9-(2,6,6-trimethylcyclohex-1-en-1-yl)nona-2,4,6,8-tetraenamide) (DIVA-PEG18).

(2E,2'E,2"E,4E,4'E,4"E,6E,6'E,6"E,8E,8'E,8"E)-N,N',N"-((5R,69R,76E,78E,80E,82E)-77,81-dimethyl-6,68,75-trioxo-83-(2,6,6-trimethylcyclohex-1-en-1-yl)-10,13,16,19,22,25,28,31,34,37,40,43,46,49,52, 55,58,61,64-nonadecaoxa-7,67,74-triazatrioctaconta-76,78,80,82-tetraene-1,5,69-triyl)tris(3,7-dimethyl-9-(2,6,6-trimethylcyclohex-1-en-1-yl)nona-2,4,6,8-tetraenamide) (DIVA-PEG18) was prepared in similar fashion as diVA with the substitution of PEG$_B$ diamine for diamido-dPEG$_{11}$-diamine. LCMS ESI+: m/z 2305 (M+Na).

Example 61: Synthesis of TriVA

Figure 47A:
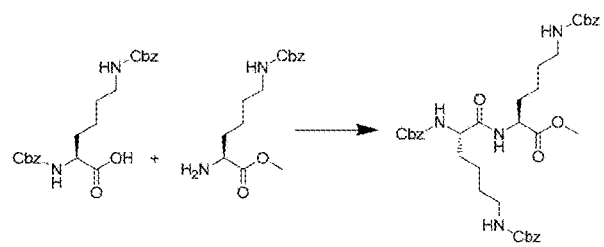
FIG. 47A shows preparation of (S)-methyl 6-(((benzyloxy)carbonyl)amino)-2-((S)-2,6-bis(((benzyloxy) carbonyl)amino)hexanamido) hexanoate.

Preparation of (S)-methyl 6-(((benzyloxy)carbonyl)amino)-2-((S)-2,6-bis(((benzyloxy)carbonyl)amino)hexanamido) hexanoate (FIG. 47A).

A flask was purged with inert gas and H-Lys(Z)—OMe HCl salt (4 g, 12.1 mmol), HOBt hydrate (1.84 g, 13.6 mmol), Z-Lys(Z)—OH (5.64 g, 13.6 mmol) are suspended in dichloromethane (50 mL). NMM (1.5 mL, 13.6 mmol) was added to the suspension and the solution became clear. A suspension EDC HCl salt (4.01 g, 20.9 mmol) and NMM (2.0 mL, 18.2 mmol) in dichloromethane (50 mL) was added over a period of 10 minutes. The reaction was stirred for 12 hours at room temperature, then washed with 1M HCl (100 mL), H$_2$O (100 mL), saturated bicarbonate solution (100 mL) and saturated brine solution (100 mL). All aqueous washes were back extracted with dichloromethane (50 mL). Dried organics with Na$_2$SO$_4$, filtered and concentrated. Material was purified by silica gel chromatography with a dichloromethane/methanol gradient to yield (S)-methyl 6-(((benzyloxy)carbonyl)amino)-2-((S)-2,6-bis(((benzyloxy)carbonyl)amino)hexanamido) hexanoate (6.91 g).

Figure 47B:
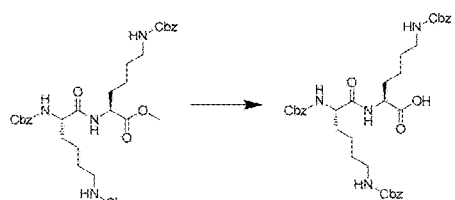
FIG. 47B shows preparation of (S)-6-(((benzyloxy)carbonyl)amino)-2-((S)-2,6-bis(((benzyloxy)carbonyl)amino)hexanamido)hexanoic acid.

Preparation of Intermediate 2: (S)-6-(((benzyloxy)carbonyl)amino)-2-((S)-2,6-bis(((benzyloxy)carbonyl)amino)hexanamido)hexanoic acid (FIG. 47B).

6-(((benzyloxy)carbonyl)amino)-2-((S)-2,6-bis(((benzyloxy)carbonyl)amino)hexanamido) hexanoate (6.91 g, 10 mmol) was dissolved with methanol (50 mL). Added KOH (2.24 g, 40 mmol) and stirred at 35° C. After 2 hours, quenched reaction by adding H$_2$O (200 mL) and washed mixture with diethyl ether (50 mL). Afterwards, adjusted the pH to ~2 with 1 M HCl acid. Extracted product with dichloromethane (3×100 mL), dried with Na$_2$SO$_4$, filtered and concentrated to yield (S)-6-(((benzyloxy)carbonyl)amino)-2-((S)-2,6-bis(((benzyloxy)carbonyl)amino)hexanamido)hexanoic acid (4 g).

Figure 47C:
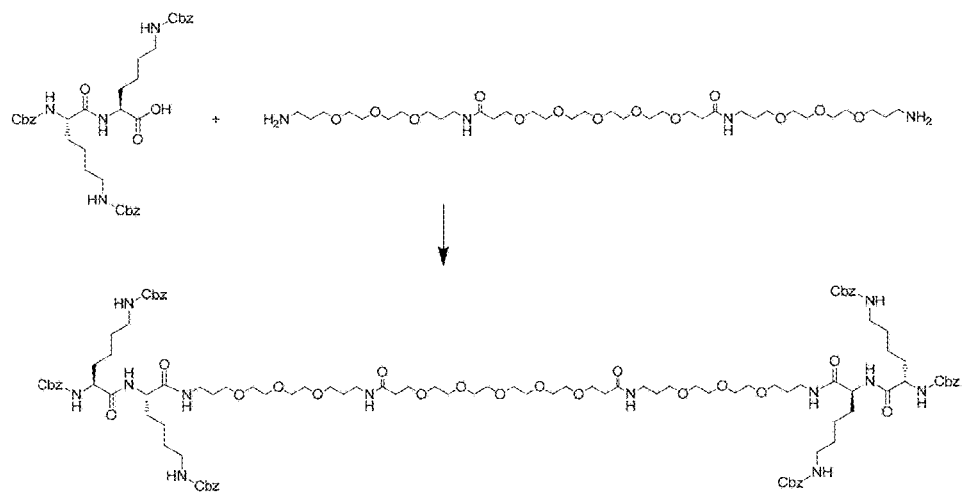
FIG. 47C shows preparation of (Cbz)$_6$-protected N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide.

Preparation of Intermediate 3: (Cbz)$_6$-protected N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide (FIG. 47C).

A flask was purged with inert gas and diamido-dPEG$_{11}$-diamine (1 g, 1.35 mmol), (S)-6-(((benzyloxy)carbonyl)amino)-2-((S)-2,6-bis(((benzyloxy)carbonyl)amino)hexanamido)hexanoic acid (2.05 g, 3.03 mmol), HOBt hydrate (409 mg, 3.03 mmol) are suspended in dichloromethane (25 mL). NMM (333 uL, 3.03 mmol) was added to the suspension and the solution became clear. A suspension EDC HCl salt (893 mg, 4.66 mmol) and NMM (445 µL, 4.05 mmol) in dichloromethane (25 mL) was added over a period of 10 minutes. The reaction was stirred for 12 hours at room temperature, then washed with 1M HCl (100 mL), water (100 mL), saturated bicarbonate solution (100 mL) and saturated brine solution (100 mL). All aqueous washes were back extracted with dichloromethane (50 mL). Dried organics with Na$_2$SO$_4$, filtered and concentrated. Material was purified by silica gel chromatography with a dichloromethane/methanol gradient to yield (Cbz)$_6$-protected N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide (480 mg).

Figure 47D:
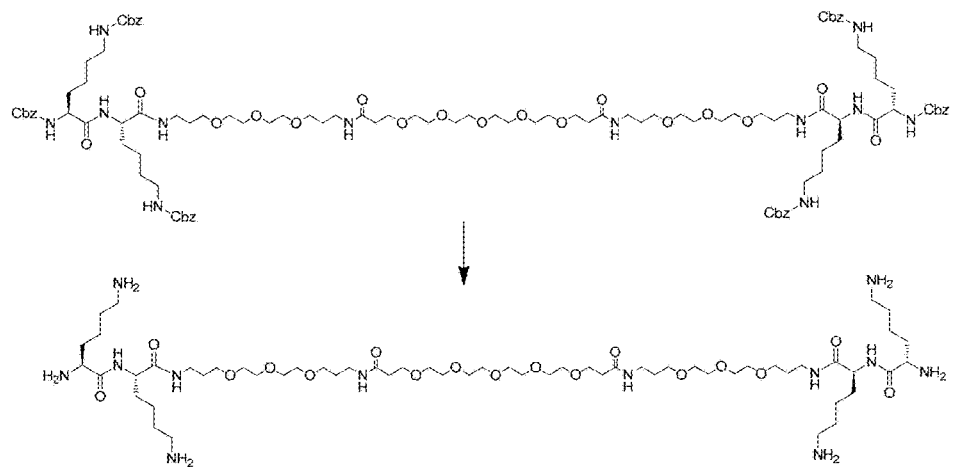
FIG. 47D shows preparation of N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide.

Preparation of Intermediate 4: N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide (FIG. 47D)

(Cbz)$_6$-protected N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide was dissolved in methanol (30 mL) in a flask and flushed with an inert gas. 10% Pd/C (135 mg) was added and the flask was once again flushed with inert gas and then all air was removed via vacuum pump. An 8 inch H$_2$ balloon was added and the reaction was allowed to stir at room temperature. After 2 hours, the Pd/C was removed by filtering through a pad of CELITE® washing with methanol, and concentrated to yield N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide (823 mg).

Figure 47E:
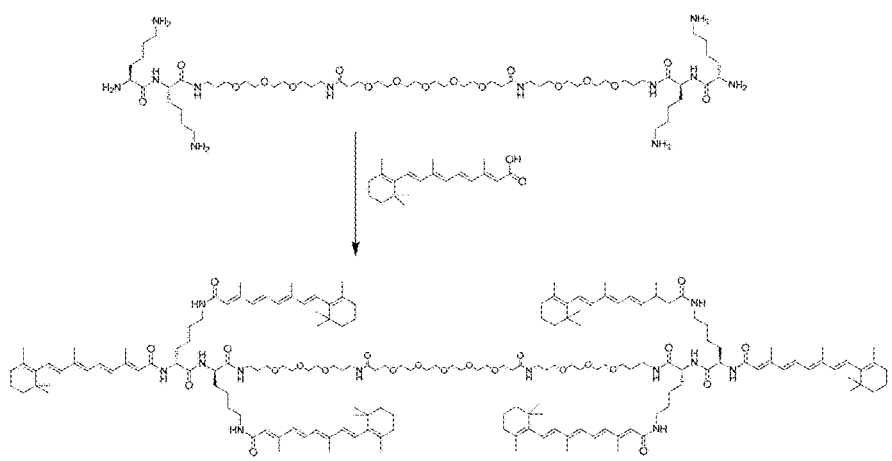
FIG. 47E shows preparation of TriVA.

Preparation of TriVA (FIG. 47E).

N1,N19-bis((16S,19S)-19,23-diamino-16-(4-aminobutyl)-15,18-dioxo-4,7,10-trioxa-14,17-diazatricosyl)-4,7,10,13,16-pentaoxanonadecane-1,19-diamide was stirred in dichloromethane and DMAP and retinoic acid was added. NMM was added and the solution was stirred in an aluminum foil covered flask flushed with inert gas at room temperature. A suspension of EDC HCl salt and NMM in dichloromethane (20 mL) was slowly added to reaction over a period of 10 minutes. Reaction was stirred for 12 hours at room temperature. Diluted with dichloromethane to 100 mL. Washed with H$_2$O (100 mL), saturated bicarbonate solution (100 mL) and saturated brine solution (100 mL). All aqueous washes were back extracted with dichloromethane (50 mL). Dried organics with Na$_2$SO$_4$, filtered and concentrated. Material was purified by basic alumina chromatography eluting with dichloromethane/ethanol gradient to yield TriVA (780 mg). LCMS ESI+: m/z 2972 (M+Na).

Example 62: Synthesis of 4TTNPB

Preparation of 4TTNPB: N1,N19-bis((R)-1,8-dioxo-7-(4-4E)-2-(5,5,8,8-tetramethyl-5,6,7,8-tetrahydro-naphthalen-2-yl)prop-1-en-1-yl)benzamido)-1-(4-4E)-2-(5,5,8,8-tetramethyl-5,6,7,8-tetrahydronaphthalen-2-yl)prop-1-en-1-yl) phenyl)-13,16,19-trioxa-2,9-diazadocosan-22-yl)-4,7,10,13,16-pentaoxanonadecane-1,19-diamide.

N1,N19-bis((R)-1,8-dioxo-7-(4-((E)-2-(5,5,8,8-tetramethyl-5,6,7,8-tetrahydro-naphthalen-2-yl)prop-1-en-1-yl) benzamido)-1-(4-4E)-2-(5,5,8,8-tetramethyl-5,6,7,8-tetrahydronaphthalen-2-yl)prop-1-en-1-yl)phenyl)-13,16,19-trioxa-2,9-diazadocosan-22-yl)-4,7,10,13,16-pentaoxanonadecane-1,19-diamide (4TTNPB), was prepared in similar fashion as N1,N19-bis((S,23E,25E,27E,29E)-16-((2E,4E,6E,8E)-3,7-dimethyl-9-(2,6,6-trimethyl-cyclo-hex-1-en-1-yl)nona-2,4,6,8-tetraenamido)-24,28-dimethyl-15,22-dioxo-30-(2,6,6-trimethylcyclohex-1-en-1-yl)-4,7,10-trioxa-14,21-diazatriaconta-23,25,27,29-tetraen-1-yl)-4,7,10,13,16-pentaoxanonadecane-1,19-diamide, referred to herein as diVA, from N1,N19-bis((S)-16,20-diamino-15-oxo-4,7,10-trioxa-14-azaicosyl)-4,7,10,13,16-pentaoxanonadecane-1,19-diamide with the substitution of TTNPB for all-trans retinoic acid. LCMS ESI+: m/z 2343 (M+Na).

Example 63: Synthesis of 4Myr

Preparation of 4Myr: N1,N19-bis((R)-15,22-dioxo-16-tetradecanamido-4,7,10-trioxa-14,21-diazapenta-triacontyl)-4,7,10,13,16-pentaoxanonadecane-1,19-diamide.

Figure 48:
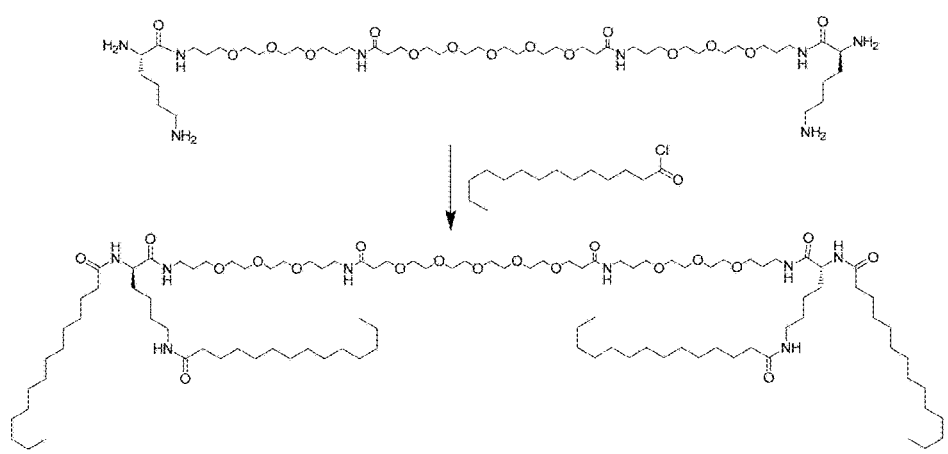
FIG. 48 shows preparation of 4Myr.

N1,N19-bis((R)-15,22-dioxo-16-tetradecanamido-4,7,10-trioxa-14,21-diaza-penta-triacontyl)-4,7,10,13,16-pentaoxanonadecane-1,19-diamide (FIG. 48).

N1,N19-bis((S)-16,20-diamino-15-oxo-4,7,10-trioxa-14-azaicosyl)-4,7,10,13,16-pentaoxanonadecane-1,19-diamide (synthesis previously described) was dissolved in dichloromethane and placed in an ice-bath. Myristoyl chloride was added followed by triethylamine. The ice-bath was removed and the reaction was allowed to stir for 12 hours at room temperature under a blanket of inert gas. Diluted with dichloromethane to 100 mL and washed with 1M HCl (75 mL), water (75 mL), saturated bicarbonate solution (75 mL) and saturated brine solution (75 mL). Back extracted all aqueous washes with dichloromethane (25 mL). Dried organics with MgSO$_4$, filtered and concentrated. Purification by silica gel chromatography with a dichloromethane/methanol gradient yielded N1,N19-bis((R)-15,22-dioxo-16-tetradecanamido-4,7,10-trioxa-14,21-diaza-penta-triacontyl)-4,7,10,13,16-pentaoxanonadecane-1,19-diamide (410 mg). LCMS ESI+: m/z 1841 (M+H).

Example 64: Synthesis of DiVA-242

Preparation of DIVA-242: N1,N16-bis((R,18E,20E,22E,24E)-11-((2E,4E,6E,8E)-3,7-dimethyl-9-(2,6,6-trimethylcyclohex-1-en-1-yl)nona-2,4,6,8-tetraenamido)-19,23-dimethyl-10,17-dioxo-25-(2,6,6-trimethylcyclohex-1-en-1-yl)-3,6-dioxa-9,16-diazapentacosa-18,20,22,24-tetraen-1-yl)-4,7,10,13-tetraoxahexadecane-1,16-diamide.

Figure 49A:
FIG. 49A preparation of di-tert-butyl(10,25-dioxo-3,6,13,16,19,22,29,32-octaoxa-9,26-diazatetratriacontane-1,34-diyl)dicarbamate.

Preparation of di-tert-butyl(10,25-dioxo-3,6,13,16,19,22,29,32-octaoxa-9,26-diazatetratriacontane-1,34-diyl)dicarbamate (FIG. 49A).

A flask containing dichloromethane (25 mL) was purged with inert gas and Bis-dPeg$_4$ acid (1000 mg, 3.40 mmol), N-Boc-3,6-dioxa-1,8-octane diamine (1816 µL, 7.65 mmol) and HOBt hydrate (1034 mg, 7.65 mmol) were added. NMM (841 µL, 7.65 mmol) was added to the suspension and the solution became clear. A suspension of EDC HCl salt (2249 mg, 11.7 mmol) and NMM (1121 uL, 10.2 mmol) in dichloromethane (25 mL) was added followed by DMAP (62 mg, 0.51 mmol). The reaction was stirred for 12 hours at room temperature. It was then diluted with dichloromethane to 100 mL and washed with H$_2$O (100 mL), 10% K$_2$CO$_3$ (100 mL) and saturated brine solution (100 mL), back extracted all aqueous washes with dichloromethane (30 mL), dried with MgSO$_4$, filtered and concentrated. Purification by silica gel chromatography with a dichloromethane/methanol gradient yielded di-tert-butyl(10,25-dioxo-3,6,13,16,19,22,29,32-octaoxa-9,26-diazatetratriacontane-1,34-diyl)dicarbamate (2.57 g).

Figure 49B:
FIG. 49B shows preparation of N1,N16-bis(2-(2-(2-aminoethoxy)ethoxy)ethyl)-4,7,10,13-tetraoxahexa-decane-1,16-diamide TFA salt.

Preparation of intermediate 2: N1,N16-bis(2-(2-(2-aminoethoxy)ethoxy)ethyl)-4,7,10,13-tetraoxahexa-decane-1,16-diamide TFA salt (FIG. 49B).

di-tert-butyl(10,25-dioxo-3,6,13,16,19,22,29,32-octaoxa-9,26-diazatetratriacontane-1,34-diyl) dicarbamate was dissolved in dichloromethane (15 mL) and placed into an ice bath, The round bottom flask was flushed with inert gas and TFA (15 mL) was added. Mixture was stirred for 20 minutes. Afterwards, the reaction mixture was concentrated to yield N1,N16-bis(2-(2-(2-aminoethoxy)ethoxy)ethyl)-4,7,10,13-tetraoxahexadecane-1,16-diamide TFA salt (1885 mg).

Figure 49C:
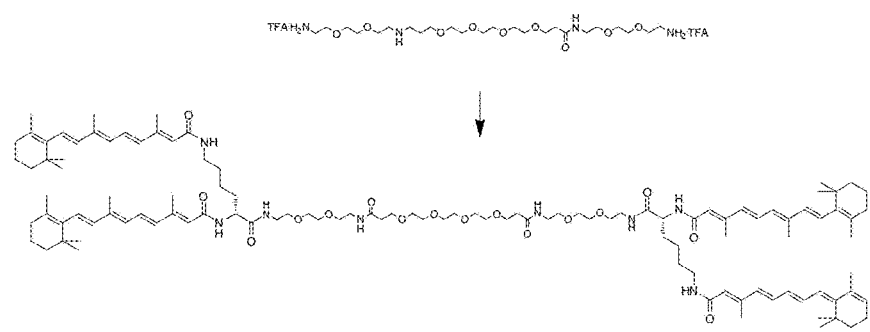
FIG. 49C shows preparation of DIVA-242.

Preparation of DIVA-242: N1,N16-bis((R,18E,20E,22E,24E)-11-((2E,4E,6E,8E)-3,7-dimethyl-9-(2,6,6-trimethylcyclohex-1-en-1-yl)nona-2,4,6,8-tetraenamido)-19,23-dimethyl-10,17-dioxo-25-(2,6,6-trimethylcyclohex-1-en-1-yl)-3,6-dioxa-9,16-diazapentacosa-18,20,22,24-tetraen-1-yl)-4,7,10,13-tetraoxahexadecane-1,16-diamide (FIG. 49C).

Synthesis of N1,N16-bis((R,18E,20E,22E,24E)-11-((2E,4E,6E,8E)-3,7-dimethyl-9-(2,6,6-trimethylcyclohex-1-en-1-yl)nona-2,4,6,8-tetraenamido)-19,23-dimethyl-10,17-dioxo-25-(2,6,6-trimethylcyclohex-1-en-1-yl)-3,6-dioxa-9,16-diazapentacosa-18,20,22,24-tetraen-1-yl)-4,7,10,13-tetraoxahexadecane-1,16-diamide (DIVA-242) follows the same protocol as diVA from N1,N16-bis(2-(2-(2-aminoethoxy)ethoxy)ethyl)-4,7,10,13-tetraoxahexadecane-1,16-diamide TFA salt. LCMS ESI+: m/z 1940 (M+H).

Example 65: In Vitro Efficacy of Fat-Soluble Vitamin Targeting Conjugate

Liposome formulations with 50 nM siRNA were tested. The liposomes were either: HEDC:S104:DOPE:Chol:PEG-DMPE:DiVA (+DiVA) or controls lacking vitamin A moieties (−DiVA) and were incubated in 96-well culture plates containing rat hepatic stellate cells for 30 minutes. After 30 minutes, medium was replaced with fresh growth medium. Forty eight hours later, cells were lysed and gp46 and GAPDH mRNA levels measured by quantitative RT-PCR (TAQMAN®) assay, and gp46 levels were normalized to GAPDH levels.

Figure 50:
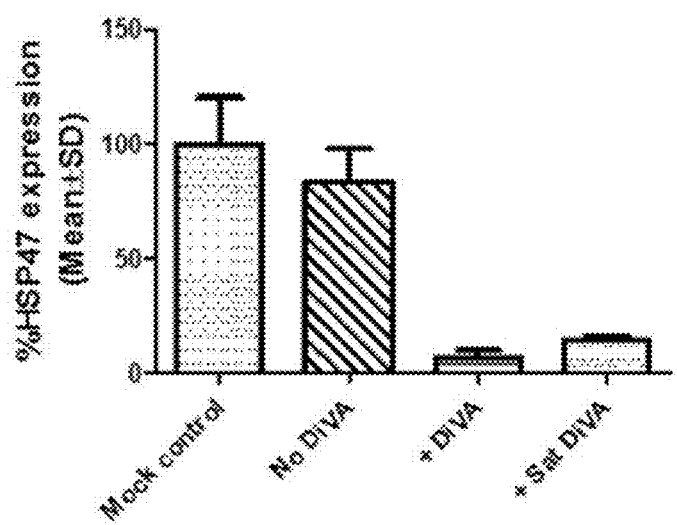
FIG. 50 shows in vitro efficacy (pHSC), effect of retinoid conjugates in liposome formulations.

As shown in FIG. 50, in vitro efficacy (pHSC), effect of 2% DiVA siRNA was efficacious with 2% diVA and had an $EC_{50}$ of 14 nM. This figure shows pHSCs in 96-well plate were incubated with formulation that lacked vitamin A moieties for targeting (−DiVA), or formulation that included vitamin A moieties (+DiVA) at 50 nM siRNA. After 30 minutes, medium was replaced with fresh growth medium. Forty eight hours later, cells were lysed and gp46 and GAPDH mRNA levels measured by quantitative RT-PCR (TAQMAN®) assay, and gp46 levels were normalized to GAPDH levels. Normalized gp46 levels were expressed as percent of mock control cells. Error bars indicate standard deviations (n=3). The mean gp46 level following DiVA containing treatment is significantly different from the mock control treatment (P<0.001) based on one-tailed t-test. Comparison of DiVA and satDiVA Liposome formulations were transfected into rat pHSCs for 30 min in 96-well plates. After 48 hours, the cells were processed using CELLS-TO-CT® lysis reagents (Applied Biosystems) and HSP47 mRNA levels were quantified by qRT-PCR. HSP47 expression was normalized mock control. $EC_{50}$ was determined by measuring HSP47 knockdown (KD) at six half-log doses of siRNA and fitting the data to the "Classic sigmoidal dose response function" in GRAPHPAD PRISM® 5.04.

Results shown that both DiVA and Sat DiVA increased KD efficacy (Table below, and FIG. 50). The $EC_{50}$ is 12 nM for DiVA and the $EC_{50}$ is 14 nM for SatDiVA.

| Retinoid Conjugate | Formulation | in vitro (pHSC) $EC_{50}$ or % KD | in vivo (rat DMNQ) % KD |
|---|---|---|---|
| DiVA | 20:20 HEDC:S104 with 2% DiVA | $EC_{50}$ = 12 nM | 60% @ 0.75 mpk |
| satDiVA | 20:20 HEDC:S104 with 2% satDiVA | $EC_{50}$ = 14 nM | 74% @ 0.75 mpk |

Retinoid Conjugate Vs Non-Retinoid Conjugate

Retinoid conjugates were found to be consistently more potent in vitro relative to the non-retinoid equivalents (see 4TTNBB and 4MYR vs. the retinoid conjugate equivalents satDiVA and DiVA).

| Compound (Type of Conjugate) | Formulation | in vitro (pHSC) $EC_{50}$ or % KD |
|---|---|---|
| DiVA (retinoid) | 20:20 HEDC:S104 with 2% DiVA | 74% @ 50 nM |
| satDiVA (retinoid) | 20:20 HEDC:S104 with 2% satDiVA | 73% @ 50 nM |
| 4TTNPB (non-retinoid) | 20:20 HEDC:S104 with 2% 4TTNPB | 34% @ 50 nM |
| 4Myr (non-retinoid) | 20:20 HEDC:S104 with 2% 4Myr | 27% @ 50 nM |

Example 66: In Vivo Efficacy of Fat-Soluble Vitamin Targeting Conjugate HEDC:S104:DOPE:Chol:PEG-DMPE:diva In vivo activity of target formulation was evaluated in the short-term liver damage model (referred to as the Quick Model, DMNQ). In this model, short-term liver damage is induced by treatment with a hepatotoxic agent such as dimethylnitrosamine (DMN), and is accompanied by the elevation of gp46 mRNA levels. To induce these changes, male Sprague-Dawley rats were injected intraperitoneally with DMN on six consecutive days. At the end of the DMN treatment period, the animals were randomized to groups based upon individual animal body weight. Formulations were administered as a single IV dose, and given one hour after the last injection of DMN. Twenty four hours later, liver lobes were excised and both gp46 and MRPL19 mRNA levels were determined by quantitative RT-PCR (TAQMAN®) assay. mRNA levels for gp46 were normalized to MRPL19 levels.

Figure 51:
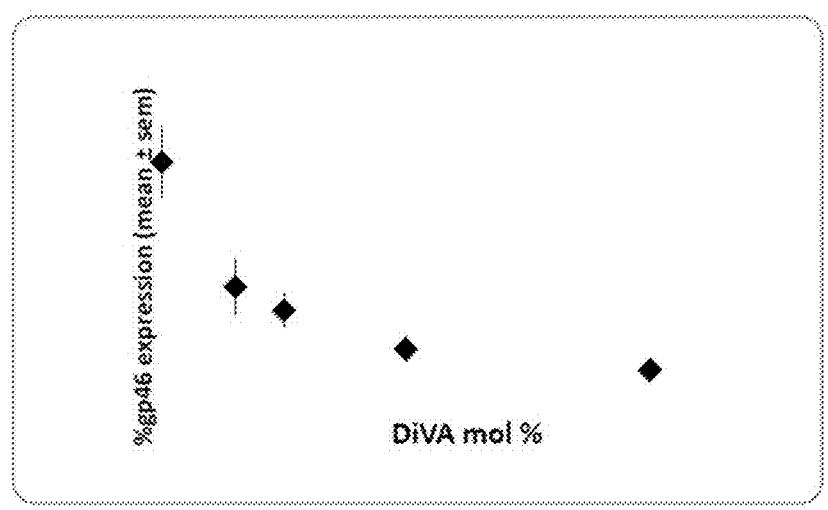
FIG. 51 shows the correlation of retinoid conjugate content (mol %) to in vivo (rat DMNQ) efficacy. Male Sprague-Dawley rats injected intravenously either with formulations containing 0, 0.25, 0.5, 1, and 2% DiVA at a dose of 0.75 mg/kg siRNA, or PBS (vehicle), one hour after the last injection of DMN.

The results (FIG. 51) show a correlation between the amount of retinoid conjugate and efficacy is evident. Only 0.25 mol % is required to see a significant effect in the rat DMNQ model. With 2 mol % DiVA a robust knockdown of gp46 expression is observed. FIG. 51 shows male S-D rats that were treated with DMN at 10 mg/kg on day 1, 2, 3 and 5 mg/kg on day 4, 5, 6 through intraperitoneal dosing to induce liver damage. Animals (n=eight/group) were injected intravenously either with formulations containing 0, 0.25, 0.5, 1, and 2% DiVA at a dose of 0.75 mg/kg siRNA, or PBS (vehicle), one hour after the last injection of DMN. Twenty four hours later, total siRNA was purified from a section of the right liver lobe from each animal and stored at 4° C. until RNA isolation. Control groups included a PBS vehicle group (DMN-treated) and naïve (untreated; no DMN) group. After subtracting background gp46 mRNA levels determined from the naïve group, all test group values were normalized to the average gp46 mRNA of the vehicle group (expressed as a percent of the vehicle group).

Male S-D rats (130-160 g) were treated DMN through intraperitoneal dosing to induce liver fibrosis. The DMN treatment regimen was 3 times each week (Mon, Wed, and Fri) with 10 mg/kg (i.e., 5.0 mg/mL of DMN at a dose of 2.0 mL/kg body weight) for first 3 weeks and half dose of 5 mg/kg (i.e., 5 mg/mL of DMN at a dose of 1.0 mL/kg) from day 22 to 57. The sham group animals were injected with PBS (solvent for DMN) using the same schedule. On Day 22, 24 h post the last DMN treatment, blood samples were collected and assayed for liver disease biomarkers to confirm the effectiveness of the DMN treatment. DMN treated animals were assigned to different treatment groups based on body weight and ensure that the mean body weights and the range of body weights of the animals in each group have no significant difference. Animals from pretreatment group were sacrificed on day 25 to evaluate the disease progression stage prior to treatment begins. Treatments with formulations containing gp46 siRNA were started at day 25 with two treatments/week at a specified siRNA dose for 10 times. On day 59, 48 hours after last formulation treatment and 72 hours after last DMN treatment, animals were sacrificed by $CO_2$ inhalation. Liver lobes were excised and both gp46 and MRPL19 mRNA levels were determined by quantitative RT-PCR (TAQMAN®) assay. mRNA levels for gp46 were normalized to MRPL19 levels It will be readily apparent to one skilled in the art that varying substitutions and modifications can be made to the description disclosed herein without departing from the scope and spirit of the description. Thus, such additional embodiments are within the scope of the present description and the following claims. The present description teaches one skilled in the art to test various combinations and/or substitutions of chemical modifications described herein toward generating nucleic acid constructs with improved activity for mediating RNAi activity. Such improved activity can include improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying nucleic acid molecules with improved RNAi activity.

The descriptions illustratively described herein may suitably be practiced in the absence of any element or elements, limitation or limitations, not specifically disclosed herein. Thus, for example, the terms "a" and "an" and "the" and similar referents in the context of describing the description (especially in the context of the following claims) are to be construed to cover both the singular and the plural, unless otherwise indicated herein or clearly contradicted by context. The terms "comprising", "having," "including," "containing", etc. shall be read expansively and without limitation (e.g., meaning "including, but not limited to,").

Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the description and does not pose a limitation on the scope of the description unless otherwise claimed. No language in the specification should be construed as indicating any non-claimed element as essential to the practice of the description. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the description claimed. Thus, it should be understood that although the present description has been specifically disclosed by preferred embodiments and optional features, modification and variation of the descriptions embodied therein herein disclosed may be resorted to by those skilled in the art, and that such modifications and variations are considered to be within the scope of this description.

The description has been described broadly and generically herein. Each of the narrower species and subgeneric groupings falling within the generic disclosure also form part of the description. This includes the generic description of the description with a proviso or negative limitation removing any subject matter from the genus, regardless of whether or not the excised material is specifically recited herein. Other embodiments are within the following claims. In addition, where features or aspects of the description are described in terms of Markush groups, those skilled in the art will recognize that the description is also thereby described in terms of any individual member or subgroup of members of the Markush group.

---

SEQUENCE LISTING (2749 sequences)

SEQ ID NO: 1 - RNA, 2208 nt, Homo sapiens
ucuuuggcuuuuuuuggcggagcuggggcgcccuccggaagcguuuccaacuuuccagaaguuucucgggacgggcaggaggggguggggacugccauauauagaucccgggagcaggggagcgggcuaagaguagaaucgugucgcggcucgagagcgagagucacgucccggcgcuagcccagcccgacccaggcccaccguggugcacgcaaaccacuuccuggccaugcgcucccuccugcuucucagcgccuucugccuccuggaggcggcccuggccgccgaggugaagaaaccugcagccgcagcagcuccuggcacugcggagaaguugagccccaaggcggccacgcuugccgagcgcagcgccggccuggccuucagcuuguaccaggccauggccaaggaccaggcaguggagaacauccuggugucacccguggugguggccucgucgcuagggcucgugucgcugggcggcaaggcgaccacggcgucgcaggccaaggcagugcugagcgccgagcagcugcgcgacgaggaggugcacgccggccugggcgagcugcugcgcucacucagcaacuccacggcgcgcaacgugaccuggaagcugggcagccgacuguacggacccagcucagugagcuucgcugaugacuucgugcgcagcagcaagcagcacuacaacugcgagcacuccaagaucaacuuccgcgacaagcgcagcgcgcugcaguccaucaacgagugggccgcgcagaccaccgacggcaagcugcccgaggucaccaaggacguggagcgcacggacggcgcccugcuagucaacgccauguucuucaagccacacugggaugagaaauuccaccacaagaugguggacaaccguggcuucauggugacucgguccuauaccgugggugucaugaugaugcaccggacaggccucuacaacuacuacgacgacgagaaggaaaagcugcaaaucguggagaugccccuggcccacaagcucuccagccucaucauccucaugccccaucacguggagccucucgagcgccuugaaaagcugcuaaccaaagagcagcugaagaucuggauggggaagaugcagaagaaggcuguugccaucuccuugcccaagggugugguggaggugacccaugaccugcagaaacaccuggcugggcugggccugacugaggccauugacaagaacaaggccgacuugucacgcaugucaggcaagaaggaccuguaccuggccagcguguuccacgccaccgccuuugaguuggacacagauggcaaccccuuugaccaggacaucuacgggcgcgaggagcugcgcagccccaagcuguucuacgccgaccaccccuucaucuuccuagugcgggacacccaaagcggcucccugcuauucauugggcgccugguccggccuaagggugacaagaugcgagacgaguuauagggccucagggugcacacaggauggcaggaggcauccaaaggcuccugagacacaugggugcuauugggguugggggggaggugagguaccagccuuggauacuccaugggguggggguggaaaaacagaccgggguucccgugugccugagcggaccuucccagcuagaauucacuccacuuggacaugggccccagauaccaugaugcugagcccggaaacuccacauccugugggaccugggccauagucauucugccugcccugaaagucccagaucaagccugccucaaucaguauucauauuuauagccagguaccuucucaccugugagaccaaauugagcuaggggggucagccagcccucuucugacacuaaaacaccucagcugccuccccagcucuaucccaaccucucccaacuauaaaacuaggugcugcagccccugggaccaggcacccccagaaugaccuggccgcagugaggcggauugagaaggagcucccaggaggggcuucugggcagacucuggucaagaagcaucgugucuggcguuguggggaugaacuuuuuguuuuguuucuuccuuuuuuaguucuucaaagauagggagggaagggggaacaugagccuuuguugcuaucaauccaagaacuuauuuguacauuuuuuuuuucaauaaaacuuuuccaaugacauuuuguuggagcguggaaaaaa

SEQ ID NO: 2 - skipped

SEQ ID NO: 3 - RNA, 21 nt, Artificial Sequence
  Description of Artificial Sequence: Synthetic oligonucleotide
ggacaggccucuacaacuauu

SEQ ID NO: 4 - RNA, 21 nt, Artificial Sequence
  Description of Artificial Sequence: Synthetic oligonucleotide
uaguuguagaggccuguccuu

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
ggacaggccucuacaacuatt

SEQ ID NO: 6 - DNA, 21 bp, Artificial Sequence
  Description of Artificial Sequence: Synthetic oligonucleotide
  Description of Combined DNA/RNA Molecule: Synthetic oligonucleotide
uaguuguagaggccugucctt

SEQ ID NO: 7 - RNA, 25 nt, Artificial Sequence
  Description of Artificial Sequence: Synthetic oligonucleotide
ggacaggccucuacaacuacuacga

SEQ ID NO: 8 - RNA, 27 nt, Artificial Sequence
  Description of Artificial Sequence: Synthetic oligonucleotide
ucguaguaguuguagaggccuguccuu

SEQ ID NO: 9 - DNA, 25 bp, Artificial Sequence
  Description of Artificial Sequence: Synthetic oligonucleotide
  Description of Combined DNA/RNA Molecule: Synthetic oligonucleotide
ggacaggccucuacaacuacuacga

SEQ ID NO: 10 - RNA, 27 nt, Artificial Sequence
  Description of Artificial Sequence: Synthetic oligonucleotide
ucguaguaguuguagaggccuguccuu

SEQ ID NO: 11 - RNA, 21 nt, Artificial Sequence
  Description of Artificial Sequence: Synthetic oligonucleotide
caggccucuacaacuacuauu

SEQ ID NO: 12 - RNA, 21 nt, Artificial Sequence
  Description of Artificial Sequence: Synthetic oligonucleotide
uaguaguuguagaggccuguu

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
caggccucuacaacuacuatt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
uaguaguuguagaggccugtt

SEQ ID NO: 15 - RNA, 25 nt, Artificial Sequence
  Description of Artificial Sequence: Synthetic oligonucleotide
caggccucuacaacuacuacgacga

SEQ ID NO: 16 - RNA, 26 nt, Artificial Sequence
  Description of Artificial Sequence: Synthetic oligonucleotide
cgucguaguaguuguagaggccuguu

SEQ ID NO: 17 - DNA, 25 bp, Artificial Sequence
  Description of Artificial Sequence: Synthetic oligonucleotide
  Description of Combined DNA/RNA Molecule: Synthetic oligonucleotide
caggccucuacaacuacuacgacga

SEQ ID NO: 18 - RNA, 26 nt, Artificial Sequence
  Description of Artificial Sequence: Synthetic oligonucleotide
cgucguaguaguuguagaggccuguu

SEQ ID NO: 19 - RNA, 21 nt, Artificial Sequence
  Description of Artificial Sequence: Synthetic oligonucleotide
gagcacuccaagaucaacuuu

SEQ ID NO: 20 - RNA, 21 nt, Artificial Sequence
  Description of Artificial Sequence: Synthetic oligonucleotide
aguugaucuuggagugcucuu

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
gagcacuccaagaucaacutt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
aguugaucuuggagugcuctt

SEQ ID NO: 23 - RNA, 25 nt, Artificial Sequence
  Description of Artificial Sequence: Synthetic oligonucleotide
gagcacuccaagaucaacuuccgcg

SEQ ID NO: 24 - RNA, 27 nt, Artificial Sequence
  Description of Artificial Sequence: Synthetic oligonucleotide
cgcggaaguugaucuuggagugcucuu

SEQ ID NO: 25 - DNA, 25 bp, Artificial Sequence
  Description of Artificial Sequence: Synthetic oligonucleotide
  Description of Combined DNA/RNA Molecule: Synthetic oligonucleotide
gagcacuccaagaucaacuuccgcg

SEQ ID NO: 26 - RNA, 26 nt, Artificial Sequence
  Description of Artificial Sequence: Synthetic oligonucleotide
gcggaaguugaucuuggagugcucuu

SEQ ID NO: 27 - RNA, 25 nt, Artificial Sequence
  Description of Artificial Sequence: Synthetic oligonucleotide
gaacacuccaagaucaacuuccgag

SEQ ID NO: 28 - RNA, 27 nt, Artificial Sequence
  Description of Artificial Sequence: Synthetic oligonucleotide
cucggaaguugaucuuggaguguucuu

SEQ ID NO: 29 - DNA, 25 bp, Artificial Sequence
  Description of Artificial Sequence: Synthetic oligonucleotide
  Description of Combined DNA/RNA Molecule: Synthetic oligonucleotide
gaacacuccaagaucaacuuccgag

SEQ ID NO: 30 - RNA, 26 nt, Artificial Sequence
  Description of Artificial Sequence: Synthetic oligonucleotide
ucggaaguugaucuuggaguguucuu

SEQ ID NO: 31 - RNA, 21 nt, Artificial Sequence
  Description of Artificial Sequence: Synthetic oligonucleotide
cugaggccauugacaagaauu

SEQ ID NO: 32 - RNA, 21 nt, Artificial Sequence
  Description of Artificial Sequence: Synthetic oligonucleotide
uucuugucaauggccucaguu

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
cugaggccauugacaagaatt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
uucuugucaauggccucagtt

SEQ ID NO: 35 - RNA, 25 nt, Artificial Sequence
  Description of Artificial Sequence: Synthetic oligonucleotide
cugaggccauugacaagaacaaggc

SEQ ID NO: 36 - RNA, 26 nt, Artificial Sequence
  Description of Artificial Sequence: Synthetic oligonucleotide
ccuuguucuugucaauggccucaguu

SEQ ID NO: 37 - DNA, 25 bp, Artificial Sequence
  Description of Artificial Sequence: Synthetic oligonucleotide
  Description of Combined DNA/RNA Molecule: Synthetic oligonucleotide
cugaggccauugacaagaacaaggc

SEQ ID NO: 38 - RNA, 27 nt, Artificial Sequence
  Description of Artificial Sequence: Synthetic oligonucleotide
gccuuguucuugucaauggccucaguu

SEQ ID NO: 39 - RNA, 21 nt, Artificial Sequence
  Description of Artificial Sequence: Synthetic oligonucleotide
cuacgacgacgagaaggaauu

SEQ ID NO: 40 - RNA, 21 nt, Artificial Sequence
  Description of Artificial Sequence: Synthetic oligonucleotide
uuccuucucgucgucguaguu

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
cuacgacgacgagaaggaatt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
uuccuucucgucgucguagtt

SEQ ID NO: 43 - RNA, 25 nt, Artificial Sequence
  Description of Artificial Sequence: Synthetic oligonucleotide
cuacgacgacgagaaggaaaagcug

SEQ ID NO: 44 - RNA, 26 nt, Artificial Sequence
  Description of Artificial Sequence: Synthetic oligonucleotide
agcuuuuccuucucgucgucguaguu

SEQ ID NO: 45 - DNA, 25 bp, Artificial Sequence
  Description of Artificial Sequence: Synthetic oligonucleotide
  Description of Combined DNA/RNA Molecule: Synthetic oligonucleotide
cuacgacgacgagaaggaaaagctg

SEQ ID NO: 46 - RNA, 26 nt, Artificial Sequence
  Description of Artificial Sequence: Synthetic oligonucleotide
agcuuuuccuucucgucgucguaguu

SEQ ID NO: 47 - RNA, 21 nt, Artificial Sequence
  Description of Artificial Sequence: Synthetic oligonucleotide
gccacacugggaugagaaauu

SEQ ID NO: 48 - RNA, 21 nt, Artificial Sequence
  Description of Artificial Sequence: Synthetic oligonucleotide
uuucucaucccaguguggcuu

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
gccacacugggaugagaaatt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
uuucucaucccaguguggctt

SEQ ID NO: 51 - RNA, 21 nt, Artificial Sequence
  Description of Artificial Sequence: Synthetic oligonucleotide
gcagcaagcagcacuacaauu

SEQ ID NO: 52 - RNA, 21 nt, Artificial Sequence
  Description of Artificial Sequence: Synthetic oligonucleotide
uuguagugcugcuugcugcuu

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
gcagcaagcagcacuacaatt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
uuguagugcugcuugcugctt

SEQ ID NO: 55 - RNA, 21 nt, Artificial Sequence
  Description of Artificial Sequence: Synthetic oligonucleotide
ccgugggugucaugaugauuu

SEQ ID NO: 56 - RNA, 21 nt, Artificial Sequence
  Description of Artificial Sequence: Synthetic oligonucleotide
aucaucaugacacccacgguu

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
ccgugggugucaugaugautt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
aucaucaugacacccacggtt

SEQ ID NO: 59 - skipped

SEQ ID NO: 60 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
gagacacaugggugcuauannnnn

SEQ ID NO: 61 - RNA, 19 nt, Artificial Sequence
  Description of Artificial Sequence: Synthetic oligonucleotide
gggaagaugcagaagaaga

SEQ ID NO: 62 - RNA, 19 nt, Artificial Sequence
  Description of Artificial Sequence: Synthetic oligonucleotide
gaagaaggcuguugccaua

SEQ ID NO: 63 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
acaagaugcgagacgaguannnnn

SEQ ID NO: 64 - RNA, 19 nt, Artificial Sequence
  Description of Artificial Sequence: Synthetic oligonucleotide
ggacaaccguggcuucaua

SEQ ID NO: 65 - RNA, 19 nt, Artificial Sequence
  Description of Artificial Sequence: Synthetic oligonucleotide
ugcaguccaucaacgagua

SEQ ID NO: 66 - RNA, 19 nt, Artificial Sequence
  Description of Artificial Sequence: Synthetic oligonucleotide
gccucaucauccucaugca

SEQ ID NO: 67 - RNA, 19 nt, Artificial Sequence
  Description of Artificial Sequence: Synthetic oligonucleotide
cgcgcugcaguccaucaaa

SEQ ID NO: 68 - RNA, 19 nt, Artificial Sequence
  Description of Artificial Sequence: Synthetic oligonucleotide
cggacaggccucuacaaca

SEQ ID NO: 69 - RNA, 19 nt, Artificial Sequence
  Description of Artificial Sequence: Synthetic oligonucleotide
ugacaagaugcgagacgaa

SEQ ID NO: 70 - RNA, 19 nt, Artificial Sequence
  Description of Artificial Sequence: Synthetic oligonucleotide
ccagccucaucauccucaa

SEQ ID NO: 71 - RNA, 19 nt, Artificial Sequence
  Description of Artificial Sequence: Synthetic oligonucleotide
gcugcaguccaucaacgaa

SEQ ID NO: 72 - RNA, 19 nt, Artificial Sequence
  Description of Artificial Sequence: Synthetic oligonucleotide
gcagcgcgcugcaguccaa

SEQ ID NO: 73 - RNA, 19 nt, Artificial Sequence
  Description of Artificial Sequence: Synthetic oligonucleotide
ugagacacaugggugcuaa

SEQ ID NO: 74 - RNA, 19 nt, Artificial Sequence
  Description of Artificial Sequence: Synthetic oligonucleotide
gguggaggugacccaugaa

SEQ ID NO: 75 - RNA, 19 nt, Artificial Sequence
  Description of Artificial Sequence: Synthetic oligonucleotide
cuuugaccaggacaucuaa

SEQ ID NO: 76 - RNA, 19 nt, Artificial Sequence
  Description of Artificial Sequence: Synthetic oligonucleotide
ggaggugacccaugaccua

SEQ ID NO: 77 - RNA, 19 nt, Artificial Sequence
  Description of Artificial Sequence: Synthetic oligonucleotide
cuccugagacacaugggua

SEQ ID NO: 78 - RNA, 19 nt, Artificial Sequence
  Description of Artificial Sequence: Synthetic oligonucleotide
agaagaaggcuguugccaa

SEQ ID NO: 79 - RNA, 19 nt, Artificial Sequence
  Description of Artificial Sequence: Synthetic oligonucleotide
agcucuccagccucaucaa

SEQ ID NO: 80 - RNA, 19 nt, Artificial Sequence
  Description of Artificial Sequence: Synthetic oligonucleotide
cugcaguccaucaacgaga

SEQ ID NO: 81 - RNA, 19 nt, Artificial Sequence
  Description of Artificial Sequence: Synthetic oligonucleotide
ccggacaggccucuacaaa

SEQ ID NO: 82 - RNA, 19 nt, Artificial Sequence
  Description of Artificial Sequence: Synthetic oligonucleotide
gcaccggacaggccucuaa

SEQ ID NO: 83 - RNA, 19 nt, Artificial Sequence
  Description of Artificial Sequence: Synthetic oligonucleotide
gcagaagaaggcuguugca

SEQ ID NO: 84 - RNA, 19 nt, Artificial Sequence
  Description of Artificial Sequence: Synthetic oligonucleotide
agaaggcuguugccaucua

SEQ ID NO: 85 - RNA, 19 nt, Artificial Sequence
  Description of Artificial Sequence: Synthetic oligonucleotide
agcgcagcgcgcugcagua

SEQ ID NO: 86 - RNA, 19 nt, Artificial Sequence
  Description of Artificial Sequence: Synthetic oligonucleotide
gacacaugggugcuauuga

SEQ ID NO: 87 - RNA, 19 nt, Artificial Sequence
  Description of Artificial Sequence: Synthetic oligonucleotide
gggccugacugaggccaua

SEQ ID NO: 88 - RNA, 19 nt, Artificial Sequence
  Description of Artificial Sequence: Synthetic oligonucleotide
agacacaugggugcuauua

SEQ ID NO: 89 - RNA, 19 nt, Artificial Sequence
  Description of Artificial Sequence: Synthetic oligonucleotide
ccaugaccugcagaaacaa

SEQ ID NO: 90 - RNA, 19 nt, Artificial Sequence
  Description of Artificial Sequence: Synthetic oligonucleotide
agaugcagaagaaggcuga

SEQ ID NO: 91 - RNA, 19 nt, Artificial Sequence
  Description of Artificial Sequence: Synthetic oligonucleotide
caagcucuccagccucaua

SEQ ID NO: 92 - RNA, 19 nt, Artificial Sequence
  Description of Artificial Sequence: Synthetic oligonucleotide
ugcagaagaaggcuguuga

SEQ ID NO: 93 - RNA, 19 nt, Artificial Sequence
  Description of Artificial Sequence: Synthetic oligonucleotide
cagccucaucauccucaua

SEQ ID NO: 94 - RNA, 19 nt, Artificial Sequence
  Description of Artificial Sequence: Synthetic oligonucleotide
gacaggccucuacaacuaa

SEQ ID NO: 95 - RNA, 19 nt, Artificial Sequence
  Description of Artificial Sequence: Synthetic oligonucleotide
gaugcagaagaaggcugua

SEQ ID NO: 96 - RNA, 19 nt, Artificial Sequence
  Description of Artificial Sequence: Synthetic oligonucleotide
acccaugaccugcagaaaa

SEQ ID NO: 97 - RNA, 19 nt, Artificial Sequence
  Description of Artificial Sequence: Synthetic oligonucleotide
acuccaagaucaacuucca

SEQ ID NO: 98 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
acuccaagaucaacuuccunnnnn

SEQ ID NO: 99 - RNA, 19 nt, Artificial Sequence
  Description of Artificial Sequence: Synthetic oligonucleotide
aggccucuacaacuacuaa

SEQ ID NO: 100 - RNA, 19 nt, Artificial Sequence
  Description of Artificial Sequence: Synthetic oligonucleotide
cacuccaagaucaacuuca

SEQ ID NO: 101 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
uccugagacacaugggugannnnn

SEQ ID NO: 102 - RNA, 19 nt, Artificial Sequence
  Description of Artificial Sequence: Synthetic oligonucleotide
gacaagaugcgagacgaga

SEQ ID NO: 103 - RNA, 19 nt, Artificial Sequence
  Description of Artificial Sequence: Synthetic oligonucleotide
ggugacccaugaccugcaa

SEQ ID NO: 104 - RNA, 19 nt, Artificial Sequence
  Description of Artificial Sequence: Synthetic oligonucleotide
ccgaggugaagaaaccuga

SEQ ID NO: 105 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
uccugagacacaugggugunnnnn

SEQ ID NO: 106 - RNA, 19 nt, Artificial Sequence
  Description of Artificial Sequence: Synthetic oligonucleotide
gcacuccaagaucaacuua

SEQ ID NO: 107 - RNA, 19 nt, Artificial Sequence
  Description of Artificial Sequence: Synthetic oligonucleotide
gugguggaggugacccaua

SEQ ID NO: 108 - RNA, 19 nt, Artificial Sequence
  Description of Artificial Sequence: Synthetic oligonucleotide
gccgaggugaagaaaccua

SEQ ID NO: 109 - RNA, 19 nt, Artificial Sequence
  Description of Artificial Sequence: Synthetic oligonucleotide
gcucuccagccucaucaua

SEQ ID NO: 110 - RNA, 19 nt, Artificial Sequence
  Description of Artificial Sequence: Synthetic oligonucleotide
gaugcaccggacaggccua

SEQ ID NO: 111 - RNA, 19 nt, Artificial Sequence
  Description of Artificial Sequence: Synthetic oligonucleotide
cucuccagccucaucauca

SEQ ID NO: 112 - RNA, 19 nt, Artificial Sequence
  Description of Artificial Sequence: Synthetic oligonucleotide
gcagaccaccgacggcaaa

SEQ ID NO: 113 - RNA, 19 nt, Artificial Sequence
  Description of Artificial Sequence: Synthetic oligonucleotide
aguccaucaacgaguggga

SEQ ID NO: 114 - RNA, 19 nt, Artificial Sequence
  Description of Artificial Sequence: Synthetic oligonucleotide
accguggcuucauggugaa

SEQ ID NO: 115 - RNA, 19 nt, Artificial Sequence
  Description of Artificial Sequence: Synthetic oligonucleotide
gaaggcuguugccaucuca

SEQ ID NO: 116 - RNA, 19 nt, Artificial Sequence
  Description of Artificial Sequence: Synthetic oligonucleotide
gaagaugcagaagaaggca

SEQ ID NO: 117 - RNA, 19 nt, Artificial Sequence
  Description of Artificial Sequence: Synthetic oligonucleotide
ugaugaugcaccggacaga

SEQ ID NO: 118 - RNA, 19 nt, Artificial Sequence
  Description of Artificial Sequence: Synthetic oligonucleotide
cccuuugaccaggacauca

SEQ ID NO: 119 - RNA, 19 nt, Artificial Sequence
  Description of Artificial Sequence: Synthetic oligonucleotide
caguccaucaacgagugga

SEQ ID NO: 120 - RNA, 19 nt, Artificial Sequence
  Description of Artificial Sequence: Synthetic oligonucleotide
caaccguggcuucauggua

SEQ ID NO: 121 - RNA, 19 nt, Artificial Sequence
  Description of Artificial Sequence: Synthetic oligonucleotide
cgacaagcgcagcgcgcua

SEQ ID NO: 122 - RNA, 19 nt, Artificial Sequence
  Description of Artificial Sequence: Synthetic oligonucleotide
gcaguccaucaacgaguga

SEQ ID NO: 123 - RNA, 19 nt, Artificial Sequence
  Description of Artificial Sequence: Synthetic oligonucleotide
acaggccucuacaacuaca

SEQ ID NO: 124 - RNA, 19 nt, Artificial Sequence
  Description of Artificial Sequence: Synthetic oligonucleotide
aagaugcagaagaaggcua

SEQ ID NO: 125 - RNA, 19 nt, Artificial Sequence
  Description of Artificial Sequence: Synthetic oligonucleotide
cagcgcgcugcaguccaua

SEQ ID NO: 126 - RNA, 19 nt, Artificial Sequence
  Description of Artificial Sequence: Synthetic oligonucleotide
gcgcagcgcgcugcaguca

SEQ ID NO: 127 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
uauagcacccaugugucucnnnnn

SEQ ID NO: 128 - RNA, 19 nt, Artificial Sequence
  Description of Artificial Sequence: Synthetic oligonucleotide
ucuucuucugcaucuuccc

SEQ ID NO: 129 - RNA, 19 nt, Artificial Sequence
  Description of Artificial Sequence: Synthetic oligonucleotide
uauggcaacagccuucuuc

SEQ ID NO: 130 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
uacucgucucgcaucuugunnnnn

SEQ ID NO: 131 - RNA, 19 nt, Artificial Sequence
  Description of Artificial Sequence: Synthetic oligonucleotide
uaugaagccacgguugucc

SEQ ID NO: 132 - RNA, 19 nt, Artificial Sequence
  Description of Artificial Sequence: Synthetic oligonucleotide
uacucguugauggacugca

SEQ ID NO: 133 - RNA, 19 nt, Artificial Sequence
  Description of Artificial Sequence: Synthetic oligonucleotide
ugcaugaggaugaugaggc

SEQ ID NO: 134 - RNA, 19 nt, Artificial Sequence
  Description of Artificial Sequence: Synthetic oligonucleotide
uuugauggacugcagcgcg

SEQ ID NO: 135 - RNA, 19 nt, Artificial Sequence
  Description of Artificial Sequence: Synthetic oligonucleotide
uguuguagaggccuguccg

SEQ ID NO: 136 - RNA, 19 nt, Artificial Sequence
  Description of Artificial Sequence: Synthetic oligonucleotide
uucgucucgcaucuuguca

SEQ ID NO: 137 - RNA, 19 nt, Artificial Sequence
  Description of Artificial Sequence: Synthetic oligonucleotide
uugaggaugaugaggcugg

SEQ ID NO: 138 - RNA, 19 nt, Artificial Sequence
  Description of Artificial Sequence: Synthetic oligonucleotide
uucguugauggacugcagc

SEQ ID NO: 139 - RNA, 19 nt, Artificial Sequence
  Description of Artificial Sequence: Synthetic oligonucleotide
uuggacugcagcgcgcugc

SEQ ID NO: 140 - RNA, 19 nt, Artificial Sequence
  Description of Artificial Sequence: Synthetic oligonucleotide
uuagcacccaugugucuca

SEQ ID NO: 141 - RNA, 19 nt, Artificial Sequence
  Description of Artificial Sequence: Synthetic oligonucleotide
uucaugggucaccuccacc

SEQ ID NO: 142 - RNA, 19 nt, Artificial Sequence
  Description of Artificial Sequence: Synthetic oligonucleotide
uuagauguccuggucaaag

SEQ ID NO: 143 - RNA, 19 nt, Artificial Sequence
  Description of Artificial Sequence: Synthetic oligonucleotide
uaggucaugggucaccucc

SEQ ID NO: 144 - RNA, 19 nt, Artificial Sequence
  Description of Artificial Sequence: Synthetic oligonucleotide
uacccaugugucucaggag

SEQ ID NO: 145 - RNA, 19 nt, Artificial Sequence
  Description of Artificial Sequence: Synthetic oligonucleotide
uuggcaacagccuucuucu

SEQ ID NO: 146 - RNA, 19 nt, Artificial Sequence
  Description of Artificial Sequence: Synthetic oligonucleotide
uugaugaggcuggagagcu

SEQ ID NO: 147 - RNA, 19 nt, Artificial Sequence
  Description of Artificial Sequence: Synthetic oligonucleotide
ucucguugauggacugcag

SEQ ID NO: 148 - RNA, 19 nt, Artificial Sequence
  Description of Artificial Sequence: Synthetic oligonucleotide
uuuguagaggccuguccgg

SEQ ID NO: 149 - RNA, 19 nt, Artificial Sequence
  Description of Artificial Sequence: Synthetic oligonucleotide
uuagaggccuguccggugc

SEQ ID NO: 150 - RNA, 19 nt, Artificial Sequence
  Description of Artificial Sequence: Synthetic oligonucleotide
ugcaacagccuucuucugc

SEQ ID NO: 151 - RNA, 19 nt, Artificial Sequence
  Description of Artificial Sequence: Synthetic oligonucleotide
uagauggcaacagccuucu

SEQ ID NO: 152 - RNA, 19 nt, Artificial Sequence
  Description of Artificial Sequence: Synthetic oligonucleotide
uacugcagcgcgcugcgcu

SEQ ID NO: 153 - RNA, 19 nt, Artificial Sequence
  Description of Artificial Sequence: Synthetic oligonucleotide
ucaauagcacccauguguc

SEQ ID NO: 154 - RNA, 19 nt, Artificial Sequence
  Description of Artificial Sequence: Synthetic oligonucleotide
uauggccucagucaggccc

SEQ ID NO: 155 - RNA, 19 nt, Artificial Sequence
  Description of Artificial Sequence: Synthetic oligonucleotide
uaauagcacccaugugucu

SEQ ID NO: 156 - RNA, 19 nt, Artificial Sequence
  Description of Artificial Sequence: Synthetic oligonucleotide
uuguuucugcaggucaugg

SEQ ID NO: 157 - RNA, 19 nt, Artificial Sequence
  Description of Artificial Sequence: Synthetic oligonucleotide
ucagccuucuucugcaucu

SEQ ID NO: 158 - RNA, 19 nt, Artificial Sequence
  Description of Artificial Sequence: Synthetic oligonucleotide
uaugaggcuggagagcuug

SEQ ID NO: 159 - RNA, 19 nt, Artificial Sequence
  Description of Artificial Sequence: Synthetic oligonucleotide
ucaacagccuucuucugca

SEQ ID NO: 160 - RNA, 19 nt, Artificial Sequence
  Description of Artificial Sequence: Synthetic oligonucleotide
uaugaggaugaugaggcug

SEQ ID NO: 161 - RNA, 19 nt, Artificial Sequence
  Description of Artificial Sequence: Synthetic oligonucleotide
uuaguuguagaggccuguc

SEQ ID NO: 162 - RNA, 19 nt, Artificial Sequence
  Description of Artificial Sequence: Synthetic oligonucleotide
uacagccuucuucugcauc

SEQ ID NO: 163 - RNA, 19 nt, Artificial Sequence
  Description of Artificial Sequence: Synthetic oligonucleotide
uuuucugcaggucaugggu

SEQ ID NO: 164 - RNA, 19 nt, Artificial Sequence
  Description of Artificial Sequence: Synthetic oligonucleotide
uggaaguugaucuuggagu

SEQ ID NO: 165 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
aggaaguugaucuuggagunnnnn

SEQ ID NO: 166 - RNA, 19 nt, Artificial Sequence
  Description of Artificial Sequence: Synthetic oligonucleotide
uuaguaguuguagaggccu

SEQ ID NO: 167 - RNA, 19 nt, Artificial Sequence
  Description of Artificial Sequence: Synthetic oligonucleotide
ugaaguugaucuuggagug

SEQ ID NO: 168 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
ucacccaugugucucaggannnnn

SEQ ID NO: 169 - RNA, 19 nt, Artificial Sequence
  Description of Artificial Sequence: Synthetic oligonucleotide
ucucgucucgcaucuuguc

SEQ ID NO: 170 - RNA, 19 nt, Artificial Sequence
  Description of Artificial Sequence: Synthetic oligonucleotide
uugcaggucaugggucacc

SEQ ID NO: 171 - RNA, 19 nt, Artificial Sequence
  Description of Artificial Sequence: Synthetic oligonucleotide
ucagguuucuucaccucgg

SEQ ID NO: 172 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
acacccaugugucucaggannnnn

SEQ ID NO: 173 - RNA, 19 nt, Artificial Sequence
  Description of Artificial Sequence: Synthetic oligonucleotide
uaaguugaucuuggagugc

SEQ ID NO: 174 - RNA, 19 nt, Artificial Sequence
  Description of Artificial Sequence: Synthetic oligonucleotide
uaugggucaccuccaccac

SEQ ID NO: 175 - RNA, 19 nt, Artificial Sequence
  Description of Artificial Sequence: Synthetic oligonucleotide
uagguuucuucaccucggc

SEQ ID NO: 176 - RNA, 19 nt, Artificial Sequence
  Description of Artificial Sequence: Synthetic oligonucleotide
uaugaugaggcuggagagc

SEQ ID NO: 177 - RNA, 19 nt, Artificial Sequence
  Description of Artificial Sequence: Synthetic oligonucleotide
uaggccuguccggugcauc

SEQ ID NO: 178 - RNA, 19 nt, Artificial Sequence
  Description of Artificial Sequence: Synthetic oligonucleotide
ugaugaugaggcuggagag

SEQ ID NO: 179 - RNA, 19 nt, Artificial Sequence
  Description of Artificial Sequence: Synthetic oligonucleotide
uuugccgucgguggucugc

SEQ ID NO: 180 - RNA, 19 nt, Artificial Sequence
  Description of Artificial Sequence: Synthetic oligonucleotide
ucccacucguugauggacu

SEQ ID NO: 181 - RNA, 19 nt, Artificial Sequence
  Description of Artificial Sequence: Synthetic oligonucleotide
uucaccaugaagccacggu

SEQ ID NO: 182 - RNA, 19 nt, Artificial Sequence
  Description of Artificial Sequence: Synthetic oligonucleotide
ugagauggcaacagccuuc

SEQ ID NO: 183 - RNA, 19 nt, Artificial Sequence
  Description of Artificial Sequence: Synthetic oligonucleotide
ugccuucuucugcaucuuc

SEQ ID NO: 184 - RNA, 19 nt, Artificial Sequence
  Description of Artificial Sequence: Synthetic oligonucleotide
ucuguccggugcaucauca

SEQ ID NO: 185 - RNA, 19 nt, Artificial Sequence
  Description of Artificial Sequence: Synthetic oligonucleotide
ugauguccuggucaaaggg

SEQ ID NO: 186 - RNA, 19 nt, Artificial Sequence
  Description of Artificial Sequence: Synthetic oligonucleotide
uccacucguugauggacug

SEQ ID NO: 187 - RNA, 19 nt, Artificial Sequence
  Description of Artificial Sequence: Synthetic oligonucleotide
uaccaugaagccacgguug

SEQ ID NO: 188 - RNA, 19 nt, Artificial Sequence
  Description of Artificial Sequence: Synthetic oligonucleotide
uagcgcgcugcgcuugucg

SEQ ID NO: 189 - RNA, 19 nt, Artificial Sequence
  Description of Artificial Sequence: Synthetic oligonucleotide
ucacucguugauggacugc

SEQ ID NO: 190 - RNA, 19 nt, Artificial Sequence
  Description of Artificial Sequence: Synthetic oligonucleotide
uguaguuguagaggccugu

SEQ ID NO: 191 - RNA, 19 nt, Artificial Sequence
  Description of Artificial Sequence: Synthetic oligonucleotide
uagccuucuucugcaucuu

SEQ ID NO: 192 - RNA, 19 nt, Artificial Sequence
  Description of Artificial Sequence: Synthetic oligonucleotide
uauggacugcagcgcgcug

SEQ ID NO: 193 - RNA, 19 nt, Artificial Sequence
  Description of Artificial Sequence: Synthetic oligonucleotide
ugacugcagcgcgcugcgc

SEQ ID NO: 194 - RNA, 19 nt, Artificial Sequence
  Description of Artificial Sequence: Synthetic oligonucleotide
ggacaggccucuacaacua

SEQ ID NO: 195 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
gagacacaugggugcuauunnnnn

SEQ ID NO: 196 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
acaagaugcgagacgaguunnnnn

SEQ ID NO: 197 - RNA, 19 nt, Artificial Sequence
  Description of Artificial Sequence: Synthetic oligonucleotide
ccuuugaccaggacaucua

SEQ ID NO: 198 - RNA, 19 nt, Artificial Sequence
  Description of Artificial Sequence: Synthetic oligonucleotide
gacccaugaccugcagaaa

SEQ ID NO: 199 - RNA, 19 nt, Artificial Sequence
  Description of Artificial Sequence: Synthetic oligonucleotide
cggacaggccucuacaacu

SEQ ID NO: 200 - RNA, 19 nt, Artificial Sequence
  Description of Artificial Sequence: Synthetic oligonucleotide
accggacaggccucuacaa

SEQ ID NO: 201 - RNA, 19 nt, Artificial Sequence
  Description of Artificial Sequence: Synthetic oligonucleotide
gcagcgcgcugcaguccau

SEQ ID NO: 202 - RNA, 19 nt, Artificial Sequence
  Description of Artificial Sequence: Synthetic oligonucleotide
gcgcgcugcaguccaucaa

SEQ ID NO: 203 - RNA, 19 nt, Artificial Sequence
  Description of Artificial Sequence: Synthetic oligonucleotide
cugagacacaugggugcua

SEQ ID NO: 204 - RNA, 19 nt, Artificial Sequence
  Description of Artificial Sequence: Synthetic oligonucleotide
agaagaaggcuguugccau

SEQ ID NO: 205 - RNA, 19 nt, Artificial Sequence
  Description of Artificial Sequence: Synthetic oligonucleotide
agcucuccagccucaucau

SEQ ID NO: 206 - RNA, 19 nt, Artificial Sequence
  Description of Artificial Sequence: Synthetic oligonucleotide
cugcaguccaucaacgagu

SEQ ID NO: 207 - RNA, 19 nt, Artificial Sequence
  Description of Artificial Sequence: Synthetic oligonucleotide
cgcugcaguccaucaacga

SEQ ID NO: 208 - RNA, 19 nt, Artificial Sequence
  Description of Artificial Sequence: Synthetic oligonucleotide
gacaagaugcgagacgagu

SEQ ID NO: 209 - RNA, 19 nt, Artificial Sequence
  Description of Artificial Sequence: Synthetic oligonucleotide
gggccugacugaggccauu

SEQ ID NO: 210 - RNA, 19 nt, Artificial Sequence
  Description of Artificial Sequence: Synthetic oligonucleotide
gaugcagaagaaggcuguu

SEQ ID NO: 211 - RNA, 19 nt, Artificial Sequence
  Description of Artificial Sequence: Synthetic oligonucleotide
caccggacaggccucuaca

SEQ ID NO: 212 - RNA, 19 nt, Artificial Sequence
  Description of Artificial Sequence: Synthetic oligonucleotide
agaugcagaagaaggcugu

SEQ ID NO: 213 - RNA, 19 nt, Artificial Sequence
  Description of Artificial Sequence: Synthetic oligonucleotide
agcgcgcugcaguccauca

SEQ ID NO: 214 - RNA, 19 nt, Artificial Sequence
  Description of Artificial Sequence: Synthetic oligonucleotide
ggaagaugcagaagaaggc

SEQ ID NO: 215 - RNA, 19 nt, Artificial Sequence
  Description of Artificial Sequence: Synthetic oligonucleotide
gaagaaggcuguugccauc

SEQ ID NO: 216 - RNA, 19 nt, Artificial Sequence
  Description of Artificial Sequence: Synthetic oligonucleotide
ugcaguccaucaacgagug

SEQ ID NO: 217 - RNA, 19 nt, Artificial Sequence
  Description of Artificial Sequence: Synthetic oligonucleotide
ccugagacacaugggugcu

SEQ ID NO: 218 - RNA, 19 nt, Artificial Sequence
  Description of Artificial Sequence: Synthetic oligonucleotide
cgcagcgcgcugcagucca

SEQ ID NO: 219 - RNA, 19 nt, Artificial Sequence
  Description of Artificial Sequence: Synthetic oligonucleotide
uaguuguagaggccugucc

SEQ ID NO: 220 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
aauagcacccaugugucucnnnnn

SEQ ID NO: 221 - RNA, 24 nt, Artificial Sequence
  Description of Artificial Sequence: Synthetic oligonucleotide
  modified_base (20)..(24): a, c, u, g, unknown or other; wherein some or all positions may be absent
  See specification as filed for detailed description of substitutions and preferred embodiments
aacucgucucgcaucuugunnnnn

SEQ ID NO: 222 - RNA, 19 nt, Artificial Sequence
  Description of Artificial Sequence: Synthetic oligonucleotide
uagauguccuggucaaagg

SEQ ID NO: 223 - RNA, 19 nt, Artificial Sequence
  Description of Artificial Sequence: Synthetic oligonucleotide
uuucugcaggucauggguc

SEQ ID NO: 224 - RNA, 19 nt, Artificial Sequence
  Description of Artificial Sequence: Synthetic oligonucleotide
aguuguagaggccuguccg

SEQ ID NO: 225 - RNA, 19 nt, Artificial Sequence
  Description of Artificial Sequence: Synthetic oligonucleotide
uuguagaggccuguccggu

SEQ ID NO: 226 - RNA, 19 nt, Artificial Sequence
  Description of Artificial Sequence: Synthetic oligonucleotide
auggacugcagcgcgcugc

SEQ ID NO: 227 - RNA, 19 nt, Artificial Sequence
  Description of Artificial Sequence: Synthetic oligonucleotide
uugauggacugcagcgcgc

SEQ ID NO: 228 - RNA, 19 nt, Artificial Sequence
  Description of Artificial Sequence: Synthetic oligonucleotide
uagcacccaugugucucag

SEQ ID NO: 229 - RNA, 19 nt, Artificial Sequence
  Description of Artificial Sequence: Synthetic oligonucleotide
auggcaacagccuucuucu

SEQ ID NO: 230 - RNA, 19 nt, Artificial Sequence
  Description of Artificial Sequence: Synthetic oligonucleotide
augaugaggcuggagagcu

SEQ ID NO: 231 - RNA, 19 nt, Artificial Sequence
  Description of Artificial Sequence: Synthetic oligonucleotide
acucguugauggacugcag

SEQ ID NO: 232 - RNA, 19 nt, Artificial Sequence
  Description of Artificial Sequence: Synthetic oligonucleotide
ucguugauggacugcagcg

SEQ ID NO: 233 - RNA, 19 nt, Artificial Sequence
  Description of Artificial Sequence: Synthetic oligonucleotide
acucgucucgcaucuuguc

SEQ ID NO: 234 - RNA, 19 nt, Artificial Sequence
  Description of Artificial Sequence: Synthetic oligonucleotide
aauggccucagucaggccc

SEQ ID NO: 235 - RNA, 19 nt, Artificial Sequence
  Description of Artificial Sequence: Synthetic oligonucleotide
aacagccuucuucugcauc

SEQ ID NO: 236 - RNA, 19 nt, Artificial Sequence
  Description of Artificial Sequence: Synthetic oligonucleotide
uguagaggccuguccggug

SEQ ID NO: 237 - RNA, 19 nt, Artificial Sequence
  Description of Artificial Sequence: Synthetic oligonucleotide
acagccuucuucugcaucu

SEQ ID NO: 238 - RNA, 19 nt, Artificial Sequence
  Description of Artificial Sequence: Synthetic oligonucleotide
ugauggacugcagcgcgcu

SEQ ID NO: 239 - RNA, 19 nt, Artificial Sequence
  Description of Artificial Sequence: Synthetic oligonucleotide
gccuucuucugcaucuucc

SEQ ID NO: 240 - RNA, 19 nt, Artificial Sequence
  Description of Artificial Sequence: Synthetic oligonucleotide
gauggcaacagccuucuuc

SEQ ID NO: 241 - RNA, 19 nt, Artificial Sequence
  Description of Artificial Sequence: Synthetic oligonucleotide
cacucguugauggacugca

SEQ ID NO: 242 - RNA, 19 nt, Artificial Sequence
  Description of Artificial Sequence: Synthetic oligonucleotide
agcacccaugugucucagg

SEQ ID NO: 243 - RNA, 19 nt, Artificial Sequence
  Description of Artificial Sequence: Synthetic oligonucleotide
uggacugcagcgcgcugcg

SEQ ID NO: 244 - RNA, 19 nt, Artificial Sequence
  Description of Artificial Sequence: Synthetic oligonucleotide
ggcagacucuggucaagaa

SEQ ID NO: 245 - RNA, 19 nt, Artificial Sequence
  Description of Artificial Sequence: Synthetic oligonucleotide
cagugaggcggauugagaa

SEQ ID NO: 246 - RNA, 19 nt, Artificial Sequence
  Description of Artificial Sequence: Synthetic oligonucleotide
agccuuuguugcuaucaau

SEQ ID NO: 247 - RNA, 19 nt, Artificial Sequence
  Description of Artificial Sequence: Synthetic oligonucleotide
ccauguucuucaagccaca

SEQ ID NO: 248 - RNA, 19 nt, Artificial Sequence
  Description of Artificial Sequence: Synthetic oligonucleotide
cccucuucugacacuaaaa

SEQ ID NO: 249 - RNA, 19 nt, Artificial Sequence
  Description of Artificial Sequence: Synthetic oligonucleotide
ccucaaucaguauucauau

SEQ ID NO: 250 - RNA, 19 nt, Artificial Sequence
  Description of Artificial Sequence: Synthetic oligonucleotide
gagacacaugggugcuauu

SEQ ID NO: 251 - RNA, 19 nt, Artificial Sequence
  Description of Artificial Sequence: Synthetic oligonucleotide
gugacaagaugcgagacga

SEQ ID NO: 252 - RNA, 19 nt, Artificial Sequence
  Description of Artificial Sequence: Synthetic oligonucleotide
gccacacugggaugagaaa

SEQ ID NO: 253 - RNA, 19 nt, Artificial Sequence
  Description of Artificial Sequence: Synthetic oligonucleotide
agaugcgagacgaguuaua

SEQ ID NO: 254 - RNA, 19 nt, Artificial Sequence
  Description of Artificial Sequence: Synthetic oligonucleotide
acgacgacgagaaggaaaa

SEQ ID NO: 255 - RNA, 19 nt, Artificial Sequence
  Description of Artificial Sequence: Synthetic oligonucleotide
gccucuacaacuacuacga

SEQ ID NO: 256 - RNA, 19 nt, Artificial Sequence
  Description of Artificial Sequence: Synthetic oligonucleotide
agaucaacuuccgcgacaa

SEQ ID NO: 257 - RNA, 19 nt, Artificial Sequence
  Description of Artificial Sequence: Synthetic oligonucleotide
acuacuacgacgacgagaa

SEQ ID NO: 258 - RNA, 19 nt, Artificial Sequence
  Description of Artificial Sequence: Synthetic oligonucleotide
agcccucuucugacacuaa

SEQ ID NO: 259 - RNA, 19 nt, Artificial Sequence
  Description of Artificial Sequence: Synthetic oligonucleotide
acaagaugcgagacgaguu

SEQ ID NO: 260 - RNA, 19 nt, Artificial Sequence
  Description of Artificial Sequence: Synthetic oligonucleotide
agccacacugggaugagaa

SEQ ID NO: 261 - RNA, 19 nt, Artificial Sequence
  Description of Artificial Sequence: Synthetic oligonucleotide
aggaccaggcaguggagaa

SEQ ID NO: 262 - RNA, 19 nt, Artificial Sequence
  Description of Artificial Sequence: Synthetic oligonucleotide
caggcaagaaggaccugua

SEQ ID NO: 263 - RNA, 19 nt, Artificial Sequence
  Description of Artificial Sequence: Synthetic oligonucleotide
accugugagaccaaauuga

SEQ ID NO: 264 - RNA, 19 nt, Artificial Sequence
  Description of Artificial Sequence: Synthetic oligonucleotide
cuuuguugcuaucaaucca

SEQ ID NO: 265 - RNA, 19 nt, Artificial Sequence
  Description of Artificial Sequence: Synthetic oligonucleotide
gugagaccaaauugagcua

SEQ ID NO: 266 - RNA, 19 nt, Artificial Sequence
  Description of Artificial Sequence: Synthetic oligonucleotide
cccugaaagucccagauca

SEQ ID NO: 267 - RNA, 19 nt, Artificial Sequence
  Description of Artificial Sequence: Synthetic oligonucleotide
ccuuugaccaggacaucua

SEQ ID NO: 268 - RNA, 19 nt, Artificial Sequence
  Description of Artificial Sequence: Synthetic oligonucleotide
gaccaggcaguggagaaca

SEQ ID NO: 269 - RNA, 19 nt, Artificial Sequence
  Description of Artificial Sequence: Synthetic oligonucleotide
cgcgcaacgugaccuggaa

SEQ ID NO: 270 - RNA, 19 nt, Artificial Sequence
  Description of Artificial Sequence: Synthetic oligonucleotide
augagaaauuccaccacaa

SEQ ID NO: 271 - RNA, 19 nt, Artificial Sequence
  Description of Artificial Sequence: Synthetic oligonucleotide
gaagaaaccugcagccgca

SEQ ID NO: 272 - RNA, 19 nt, Artificial Sequence
  Description of Artificial Sequence: Synthetic oligonucleotide
cucucgagcgccuugaaaa

SEQ ID NO: 273 - RNA, 19 nt, Artificial Sequence
  Description of Artificial Sequence: Synthetic oligonucleotide
ggaacaugagccuuuguug

SEQ ID NO: 274 - RNA, 19 nt, Artificial Sequence
  Description of Artificial Sequence: Synthetic oligonucleotide
cucaccugugagaccaaau

SEQ ID NO: 275 - RNA, 19 nt, Artificial Sequence
  Description of Artificial Sequence: Synthetic oligonucleotide
cuacgacgacgagaaggaa

SEQ ID NO: 276 - RNA, 19 nt, Artificial Sequence
  Description of Artificial Sequence: Synthetic oligonucleotide
accacaagaugguggacaa

SEQ ID NO: 277 - RNA, 19 nt, Artificial Sequence
  Description of Artificial Sequence: Synthetic oligonucleotide
cuggcacugcggagaaguu

SEQ ID NO: 278 - RNA, 19 nt, Artificial Sequence
  Description of Artificial Sequence: Synthetic oligonucleotide
gguccuauaccgugggugu

SEQ ID NO: 279 - RNA, 19 nt, Artificial Sequence
  Description of Artificial Sequence: Synthetic oligonucleotide
ccaaccucucccaacuaua

SEQ ID NO: 280 - RNA, 19 nt, Artificial Sequence
  Description of Artificial Sequence: Synthetic oligonucleotide
gagaaggaaaagcugcaaa

SEQ ID NO: 281 - RNA, 19 nt, Artificial Sequence
  Description of Artificial Sequence: Synthetic oligonucleotide
gccucucgagcgccuugaa

SEQ ID NO: 282 - RNA, 19 nt, Artificial Sequence
  Description of Artificial Sequence: Synthetic oligonucleotide
aggccauugacaagaacaa

SEQ ID NO: 283 - RNA, 19 nt, Artificial Sequence
  Description of Artificial Sequence: Synthetic oligonucleotide
gacccaugaccugcagaaa

SEQ ID NO: 284 - RNA, 19 nt, Artificial Sequence
  Description of Artificial Sequence: Synthetic oligonucleotide
cuccuggcacugcggagaa

SEQ ID NO: 285 - RNA, 19 nt, Artificial Sequence
  Description of Artificial Sequence: Synthetic oligonucleotide
cggacaggccucuacaacu

SEQ ID NO: 286 - RNA, 19 nt, Artificial Sequence
  Description of Artificial Sequence: Synthetic oligonucleotide
gaugagaaauuccaccaca

SEQ ID NO: 287 - RNA, 19 nt, Artificial Sequence
  Description of Artificial Sequence: Synthetic oligonucleotide
cacgcaugucaggcaagaa

SEQ ID NO: 288 - RNA, 19 nt, Artificial Sequence
  Description of Artificial Sequence: Synthetic oligonucleotide
accucucccaacuauaaaa

SEQ ID NO: 289 - RNA, 19 nt, Artificial Sequence
  Description of Artificial Sequence: Synthetic oligonucleotide
accaggcaguggagaacau

SEQ ID NO: 290 - RNA, 19 nt, Artificial Sequence
  Description of Artificial Sequence: Synthetic oligonucleotide
gggaacaugagccuuuguu

SEQ ID NO: 291 - RNA, 19 nt, Artificial Sequence
  Description of Artificial Sequence: Synthetic oligonucleotide
agaauucacuccacuugga

SEQ ID NO: 292 - RNA, 19 nt, Artificial Sequence
  Description of Artificial Sequence: Synthetic oligonucleotide
gggcagacucuggucaaga

SEQ ID NO: 293 - RNA, 19 nt, Artificial Sequence
  Description of Artificial Sequence: Synthetic oligonucleotide
agaaggaaaagcugcaaau

SEQ ID NO: 294 - RNA, 19 nt, Artificial Sequence
  Description of Artificial Sequence: Synthetic oligonucleotide
ggcaguggagaacauccug

SEQ ID NO: 295 - RNA, 19 nt, Artificial Sequence
  Description of Artificial Sequence: Synthetic oligonucleotide
gggaugagaaauuccacca

SEQ ID NO: 296 - RNA, 19 nt, Artificial Sequence
  Description of Artificial Sequence: Synthetic oligonucleotide
ccaagcuguucuacgccga

SEQ ID NO: 297 - RNA, 19 nt, Artificial Sequence
  Description of Artificial Sequence: Synthetic oligonucleotide
accggacaggccucuacaa

SEQ ID NO: 298 - RNA, 19 nt, Artificial Sequence
  Description of Artificial Sequence: Synthetic oligonucleotide
cugccucaaucaguauuca

SEQ ID NO: 299 - RNA, 19 nt, Artificial Sequence
  Description of Artificial Sequence: Synthetic oligonucleotide
cagcccucuucugacacua

SEQ ID NO: 300 - RNA, 19 nt, Artificial Sequence
  Description of Artificial Sequence: Synthetic oligonucleotide
ccagccucaucauccucau

SEQ ID NO: 301 - RNA, 19 nt, Artificial Sequence
  Description of Artificial Sequence: Synthetic oligonucleotide
agggugacaagaugcgaga

SEQ ID NO: 302 - RNA, 19 nt, Artificial Sequence
  Description of Artificial Sequence: Synthetic oligonucleotide
ggaccaggcaguggagaac

SEQ ID NO: 303 - RNA, 19 nt, Artificial Sequence
  Description of Artificial Sequence: Synthetic oligonucleotide
gcagcgcgcugcaguccau

SEQ ID NO: 304 - RNA, 19 nt, Artificial Sequence
  Description of Artificial Sequence: Synthetic oligonucleotide
gcgcgcugcaguccaucaa

SEQ ID NO: 305 - RNA, 19 nt, Artificial Sequence
  Description of Artificial Sequence: Synthetic oligonucleotide
ccagauaccaugaugcuga

SEQ ID NO: 306 - RNA, 19 nt, Artificial Sequence
  Description of Artificial Sequence: Synthetic oligonucleotide
cuagugcgggacacccaaa

SEQ ID NO: 307 - RNA, 19 nt, Artificial Sequence
  Description of Artificial Sequence: Synthetic oligonucleotide
aggcaguggagaacauccu

SEQ ID NO: 308 - RNA, 19 nt, Artificial Sequence
  Description of Artificial Sequence: Synthetic oligonucleotide
cugagacacaugggugcua

SEQ ID NO: 309 - RNA, 19 nt, Artificial Sequence
  Description of Artificial Sequence: Synthetic oligonucleotide
gauugagaaggagcuccca

SEQ ID NO: 310 - RNA, 19 nt, Artificial Sequence
  Description of Artificial Sequence: Synthetic oligonucleotide
cgcagaccaccgacggcaa

SEQ ID NO: 311 - RNA, 19 nt, Artificial Sequence
  Description of Artificial Sequence: Synthetic oligonucleotide
ccacacugggaugagaaau

SEQ ID NO: 312 - RNA, 19 nt, Artificial Sequence
  Description of Artificial Sequence: Synthetic oligonucleotide
gcucagugagcuucgcuga

SEQ ID NO: 313 - RNA, 19 nt, Artificial Sequence
  Description of Artificial Sequence: Synthetic oligonucleotide
cgccuuugaguuggacaca

SEQ ID NO: 314 - RNA, 19 nt, Artificial Sequence
  Description of Artificial Sequence: Synthetic oligonucleotide
gggucagccagcccucuuc

SEQ ID NO: 315 - RNA, 19 nt, Artificial Sequence
  Description of Artificial Sequence: Synthetic oligonucleotide
gggcuucugggcagacucu

SEQ ID NO: 316 - RNA, 19 nt, Artificial Sequence
  Description of Artificial Sequence: Synthetic oligonucleotide
gguaccuucucaccuguga

SEQ ID NO: 317 - RNA, 19 nt, Artificial Sequence
  Description of Artificial Sequence: Synthetic oligonucleotide
gccugccucaaucaguauu

SEQ ID NO: 318 - RNA, 19 nt, Artificial Sequence
  Description of Artificial Sequence: Synthetic oligonucleotide
ucuacaacuacuacgacga

SEQ ID NO: 319 - RNA, 19 nt, Artificial Sequence
  Description of Artificial Sequence: Synthetic oligonucleotide
gggaagaugcagaagaagg

SEQ ID NO: 320 - RNA, 19 nt, Artificial Sequence
  Description of Artificial Sequence: Synthetic oligonucleotide
cgagaaggaaaagcugcaa

SEQ ID NO: 321 - RNA, 19 nt, Artificial Sequence
  Description of Artificial Sequence: Synthetic oligonucleotide
agaagaaggcuguugccau

SEQ ID NO: 322 - RNA, 19 nt, Artificial Sequence
  Description of Artificial Sequence: Synthetic oligonucleotide
cacaagcucuccagccuca

SEQ ID NO: 323 - RNA, 19 nt, Artificial Sequence
  Description of Artificial Sequence: Synthetic oligonucleotide
gggugacaagaugcgagac

SEQ ID NO: 324 - RNA, 19 nt, Artificial Sequence
  Description of Artificial Sequence: Synthetic oligonucleotide
uguuggagcguggaaaaaa

SEQ ID NO: 325 - RNA, 19 nt, Artificial Sequence
  Description of Artificial Sequence: Synthetic oligonucleotide
cuuugaguuggacacagau

SEQ ID NO: 326 - RNA, 19 nt, Artificial Sequence
  Description of Artificial Sequence: Synthetic oligonucleotide
agcucuccagccucaucau

SEQ ID NO: 327 - RNA, 19 nt, Artificial Sequence
  Description of Artificial Sequence: Synthetic oligonucleotide
agcuguucuacgccgacca

SEQ ID NO: 328 - RNA, 19 nt, Artificial Sequence
  Description of Artificial Sequence: Synthetic oligonucleotide
cugcaguccaucaacgagu

SEQ ID NO: 329 - RNA, 19 nt, Artificial Sequence
  Description of Artificial Sequence: Synthetic oligonucleotide
uacgacgacgagaaggaaa

SEQ ID NO: 330 - RNA, 19 nt, Artificial Sequence
  Description of Artificial Sequence: Synthetic oligonucleotide
ccuagugcgggacacccaa

SEQ ID NO: 331 - RNA, 19 nt, Artificial Sequence
  Description of Artificial Sequence: Synthetic oligonucleotide
cuucucaccugugagacca

SEQ ID NO: 332 - RNA, 19 nt, Artificial Sequence
  Description of Artificial Sequence: Synthetic oligonucleotide
aguuggacacagauggcaa

SEQ ID NO: 333 - RNA, 19 nt, Artificial Sequence
  Description of Artificial Sequence: Synthetic oligonucleotide
caguggagaacauccuggu

SEQ ID NO: 334 - RNA, 19 nt, Artificial Sequence
  Description of Artificial Sequence: Synthetic oligonucleotide
ccagcuagaauucacucca

SEQ ID NO: 335 - RNA, 19 nt, Artificial Sequence
  Description of Artificial Sequence: Synthetic oligonucleotide
cgcugcaguccaucaacga

SEQ ID NO: 336 - RNA, 19 nt, Artificial Sequence
  Description of Artificial Sequence: Synthetic oligonucleotide
ccaaggaccaggcagugga

SEQ ID NO: 337 - RNA, 19 nt, Artificial Sequence
  Description of Artificial Sequence: Synthetic oligonucleotide
aguucuucaaagauaggga

SEQ ID NO: 338 - RNA, 19 nt, Artificial Sequence
  Description of Artificial Sequence: Synthetic oligonucleotide
cggaccuucccagcuagaa

SEQ ID NO: 339 - RNA, 19 nt, Artificial Sequence
  Description of Artificial Sequence: Synthetic oligonucleotide
gacaagaugcgagacgagu

SEQ ID NO: 340 - RNA, 19 nt, Artificial Sequence
  Description of Artificial Sequence: Synthetic oligonucleotide
ccaagaucaacuuccgcga

SEQ ID NO: 341 - RNA, 19 nt, Artificial Sequence
  Description of Artificial Sequence: Synthetic oligonucleotide
cccaucacguggagccucu

SEQ ID NO: 342 - RNA, 19 nt, Artificial Sequence
  Description of Artificial Sequence: Synthetic oligonucleotide
ccaugaugcugagcccgga

SEQ ID NO: 343 - RNA, 19 nt, Artificial Sequence
  Description of Artificial Sequence: Synthetic oligonucleotide
agccugccucaaucaguau

SEQ ID NO: 344 - RNA, 19 nt, Artificial Sequence
  Description of Artificial Sequence: Synthetic oligonucleotide
cggccuaagggugacaaga

SEQ ID NO: 345 - RNA, 19 nt, Artificial Sequence
  Description of Artificial Sequence: Synthetic oligonucleotide
gggccugacugaggccauu

SEQ ID NO: 346 - RNA, 19 nt, Artificial Sequence
  Description of Artificial Sequence: Synthetic oligonucleotide
ucaccugugagaccaaauu

SEQ ID NO: 347 - RNA, 19 nt, Artificial Sequence
  Description of Artificial Sequence: Synthetic oligonucleotide
gaggccauugacaagaaca

SEQ ID NO: 348 - RNA, 19 nt, Artificial Sequence
  Description of Artificial Sequence: Synthetic oligonucleotide
gcuccuggcacugcggaga

SEQ ID NO: 349 - RNA, 19 nt, Artificial Sequence
  Description of Artificial Sequence: Synthetic oligonucleotide
ggcgccugguccggccuaa

SEQ ID NO: 350 - RNA, 19 nt, Artificial Sequence
  Description of Artificial Sequence: Synthetic oligonucleotide
ccagcccucuucugacacu

SEQ ID NO: 351 - RNA, 19 nt, Artificial Sequence
  Description of Artificial Sequence: Synthetic oligonucleotide
acuacgacgacgagaagga

SEQ ID NO: 352 - RNA, 19 nt, Artificial Sequence
  Description of Artificial Sequence: Synthetic oligonucleotide
ccuauaccgugggugucau

SEQ ID NO: 353 - RNA, 19 nt, Artificial Sequence
  Description of Artificial Sequence: Synthetic oligonucleotide
gacccagcucagugagcuu

SEQ ID NO: 354 - RNA, 19 nt, Artificial Sequence
  Description of Artificial Sequence: Synthetic oligonucleotide
ugggugucaugaugaugca

SEQ ID NO: 355 - RNA, 19 nt, Artificial Sequence
  Description of Artificial Sequence: Synthetic oligonucleotide
ccaagggugugguggaggu

SEQ ID NO: 356 - RNA, 19 nt, Artificial Sequence
  Description of Artificial Sequence: Synthetic oligonucleotide
aggucaccaaggacgugga

SEQ ID NO: 357 - RNA, 19 nt, Artificial Sequence
  Description of Artificial Sequence: Synthetic oligonucleotide
cccuggccgccgaggugaa

SEQ ID NO: 358 - RNA, 19 nt, Artificial Sequence
  Description of Artificial Sequence: Synthetic oligonucleotide
agcacuccaagaucaacuu

SEQ ID NO: 359 - RNA, 19 nt, Artificial Sequence
  Description of Artificial Sequence: Synthetic oligonucleotide
ccuggcacugcggagaagu

SEQ ID NO: 360 - RNA, 19 nt, Artificial Sequence
  Description of Artificial Sequence: Synthetic oligonucleotide
gaugcagaagaaggcuguu

SEQ ID NO: 361 - RNA, 19 nt, Artificial Sequence
  Description of Artificial Sequence: Synthetic oligonucleotide
cccacaagcucuccagccu

SEQ ID NO: 362 - RNA, 19 nt, Artificial Sequence
  Description of Artificial Sequence: Synthetic oligonucleotide
cucuucugacacuaaaaca

SEQ ID NO: 363 - RNA, 19 nt, Artificial Sequence
  Description of Artificial Sequence: Synthetic oligonucleotide
acgagaaggaaaagcugca

SEQ ID NO: 364 - RNA, 19 nt, Artificial Sequence
  Description of Artificial Sequence: Synthetic oligonucleotide
ugaaaagcugcuaaccaaa

SEQ ID NO: 365 - RNA, 19 nt, Artificial Sequence
  Description of Artificial Sequence: Synthetic oligonucleotide
ucucaccugugagaccaaa

SEQ ID NO: 366 - RNA, 19 nt, Artificial Sequence
  Description of Artificial Sequence: Synthetic oligonucleotide
caugaugaugcaccggaca

SEQ ID NO: 367 - RNA, 19 nt, Artificial Sequence
  Description of Artificial Sequence: Synthetic oligonucleotide
ggauugagaaggagcuccc

SEQ ID NO: 368 - RNA, 19 nt, Artificial Sequence
  Description of Artificial Sequence: Synthetic oligonucleotide
ccuucaucuuccuagugcg

SEQ ID NO: 369 - RNA, 19 nt, Artificial Sequence
  Description of Artificial Sequence: Synthetic oligonucleotide
ggccuggccuucagcuugu

SEQ ID NO: 370 - RNA, 19 nt, Artificial Sequence
  Description of Artificial Sequence: Synthetic oligonucleotide
ggucagccagcccucuucu

SEQ ID NO: 371 - RNA, 19 nt, Artificial Sequence
  Description of Artificial Sequence: Synthetic oligonucleotide
uucucaccugugagaccaa

SEQ ID NO: 372 - RNA, 19 nt, Artificial Sequence
  Description of Artificial Sequence: Synthetic oligonucleotide
cgcagcagcuccuggcacu

SEQ ID NO: 373 - RNA, 19 nt, Artificial Sequence
  Description of Artificial Sequence: Synthetic oligonucleotide
gccauguucuucaagccac

SEQ ID NO: 374 - RNA, 19 nt, Artificial Sequence
  Description of Artificial Sequence: Synthetic oligonucleotide
aggcagugcugagcgccga

SEQ ID NO: 375 - RNA, 19 nt, Artificial Sequence
  Description of Artificial Sequence: Synthetic oligonucleotide
caccugugagaccaaauug

SEQ ID NO: 376 - RNA, 19 nt, Artificial Sequence
  Description of Artificial Sequence: Synthetic oligonucleotide
caccggacaggccucuaca

SEQ ID NO: 377 - RNA, 19 nt, Artificial Sequence
  Description of Artificial Sequence: Synthetic oligonucleotide
agcuagaauucacuccacu

SEQ ID NO: 378 - RNA, 19 nt, Artificial Sequence
  Description of Artificial Sequence: Synthetic oligonucleotide
agaugcagaagaaggcugu

SEQ ID NO: 379 - RNA, 19 nt, Artificial Sequence
  Description of Artificial Sequence: Synthetic oligonucleotide
cccugcuagucaacgccau

SEQ ID NO: 380 - RNA, 19 nt, Artificial Sequence
  Description of Artificial Sequence: Synthetic oligonucleotide
acaacuacuacgacgacga

SEQ ID NO: 381 - RNA, 19 nt, Artificial Sequence
  Description of Artificial Sequence: Synthetic oligonucleotide
gcuccugagacacaugggu

SEQ ID NO: 382 - RNA, 19 nt, Artificial Sequence
  Description of Artificial Sequence: Synthetic oligonucleotide
uggagaacauccugguguc

SEQ ID NO: 383 - RNA, 19 nt, Artificial Sequence
  Description of Artificial Sequence: Synthetic oligonucleotide
agcgcgcugcaguccauca

SEQ ID NO: 384 - RNA, 19 nt, Artificial Sequence
  Description of Artificial Sequence: Synthetic oligonucleotide
cgccuugaaaagcugcuaa

SEQ ID NO: 385 - RNA, 19 nt, Artificial Sequence
  Description of Artificial Sequence: Synthetic oligonucleotide
gccuuuguugcuaucaauc

SEQ ID NO: 386 - RNA, 19 nt, Artificial Sequence
  Description of Artificial Sequence: Synthetic oligonucleotide
cucuacaacuacuacgacg

SEQ ID NO: 387 - RNA, 19 nt, Artificial Sequence
  Description of Artificial Sequence: Synthetic oligonucleotide
cgcucacucagcaacucca

SEQ ID NO: 388 - RNA, 19 nt, Artificial Sequence
  Description of Artificial Sequence: Synthetic oligonucleotide
gguaccagccuuggauacu

SEQ ID NO: 389 - RNA, 19 nt, Artificial Sequence
  Description of Artificial Sequence: Synthetic oligonucleotide
gccugacugaggccauuga

SEQ ID NO: 390 - RNA, 19 nt, Artificial Sequence
  Description of Artificial Sequence: Synthetic oligonucleotide
ugagcuucgcugaugacuu

SEQ ID NO: 391 - RNA, 19 nt, Artificial Sequence
  Description of Artificial Sequence: Synthetic oligonucleotide
ccagccuuggauacuccau

SEQ ID NO: 392 - RNA, 19 nt, Artificial Sequence
  Description of Artificial Sequence: Synthetic oligonucleotide
aaaggcuccugagacacau

SEQ ID NO: 393 - RNA, 19 nt, Artificial Sequence
  Description of Artificial Sequence: Synthetic oligonucleotide
ugacccaugaccugcagaa

SEQ ID NO: 394 - RNA, 19 nt, Artificial Sequence
  Description of Artificial Sequence: Synthetic oligonucleotide
ccugugagaccaaauugag

SEQ ID NO: 395 - RNA, 19 nt, Artificial Sequence
  Description of Artificial Sequence: Synthetic oligonucleotide
gcggaccuucccagcuaga

SEQ ID NO: 396 - RNA, 19 nt, Artificial Sequence
  Description of Artificial Sequence: Synthetic oligonucleotide
ggaagaugcagaagaaggc

SEQ ID NO: 397 - RNA, 19 nt, Artificial Sequence
  Description of Artificial Sequence: Synthetic oligonucleotide
ugcccaaggguguggugga

SEQ ID NO: 398 - RNA, 19 nt, Artificial Sequence
  Description of Artificial Sequence: Synthetic oligonucleotide
ggagccucucgagcgccuu

SEQ ID NO: 399 - RNA, 19 nt, Artificial Sequence
  Description of Artificial Sequence: Synthetic oligonucleotide
gacucuggucaagaagcau

SEQ ID NO: 400 - RNA, 19 nt, Artificial Sequence
  Description of Artificial Sequence: Synthetic oligonucleotide
caggcaguggagaacaucc

SEQ ID NO: 401 - RNA, 19 nt, Artificial Sequence
  Description of Artificial Sequence: Synthetic oligonucleotide
caagccugccucaaucagu

SEQ ID NO: 402 - RNA, 19 nt, Artificial Sequence
  Description of Artificial Sequence: Synthetic oligonucleotide
cuggaagcugggcagccga

SEQ ID NO: 403 - RNA, 19 nt, Artificial Sequence
  Description of Artificial Sequence: Synthetic oligonucleotide
gaagaaggcuguugccauc

SEQ ID NO: 404 - RNA, 19 nt, Artificial Sequence
  Description of Artificial Sequence: Synthetic oligonucleotide
gggcgagcugcugcgcuca

SEQ ID NO: 405 - RNA, 19 nt, Artificial Sequence
  Description of Artificial Sequence: Synthetic oligonucleotide
aagccacacugggaugaga

SEQ ID NO: 406 - RNA, 19 nt, Artificial Sequence
  Description of Artificial Sequence: Synthetic oligonucleotide
gugugguggaggugaccca

SEQ ID NO: 407 - RNA, 19 nt, Artificial Sequence
  Description of Artificial Sequence: Synthetic oligonucleotide
ccgccuuugaguuggacac

SEQ ID NO: 408 - RNA, 19 nt, Artificial Sequence
  Description of Artificial Sequence: Synthetic oligonucleotide
ggccauugacaagaacaag

SEQ ID NO: 409 - RNA, 19 nt, Artificial Sequence
  Description of Artificial Sequence: Synthetic oligonucleotide
ugccucaaucaguauucau

SEQ ID NO: 410 - RNA, 19 nt, Artificial Sequence
  Description of Artificial Sequence: Synthetic oligonucleotide
ccuucccagcuagaauuca

SEQ ID NO: 411 - RNA, 19 nt, Artificial Sequence
  Description of Artificial Sequence: Synthetic oligonucleotide
gggaccugggccauaguca

SEQ ID NO: 412 - RNA, 19 nt, Artificial Sequence
  Description of Artificial Sequence: Synthetic oligonucleotide
cgaggugaagaaaccugca

SEQ ID NO: 413 - RNA, 19 nt, Artificial Sequence
  Description of Artificial Sequence: Synthetic oligonucleotide
gccuuugaguuggacacag

SEQ ID NO: 414 - RNA, 19 nt, Artificial Sequence
  Description of Artificial Sequence: Synthetic oligonucleotide
agcggaccuucccagcuag

SEQ ID NO: 415 - RNA, 19 nt, Artificial Sequence
  Description of Artificial Sequence: Synthetic oligonucleotide
cgcaugucaggcaagaagg

SEQ ID NO: 416 - RNA, 19 nt, Artificial Sequence
  Description of Artificial Sequence: Synthetic oligonucleotide
acaacugcgagcacuccaa

SEQ ID NO: 417 - RNA, 19 nt, Artificial Sequence
  Description of Artificial Sequence: Synthetic oligonucleotide
gaggcggauugagaaggag

SEQ ID NO: 418 - RNA, 19 nt, Artificial Sequence
  Description of Artificial Sequence: Synthetic oligonucleotide
ggccgccgaggugaagaaa

SEQ ID NO: 419 - RNA, 19 nt, Artificial Sequence
  Description of Artificial Sequence: Synthetic oligonucleotide
cagcucuaucccaaccucu

SEQ ID NO: 420 - RNA, 19 nt, Artificial Sequence
  Description of Artificial Sequence: Synthetic oligonucleotide
agcugggcagccgacugua

SEQ ID NO: 421 - RNA, 19 nt, Artificial Sequence
  Description of Artificial Sequence: Synthetic oligonucleotide
gccauugacaagaacaagg

SEQ ID NO: 422 - RNA, 19 nt, Artificial Sequence
  Description of Artificial Sequence: Synthetic oligonucleotide
cgccauguucuucaagcca

SEQ ID NO: 423 - RNA, 19 nt, Artificial Sequence
  Description of Artificial Sequence: Synthetic oligonucleotide
ccgaggucaccaaggacgu

SEQ ID NO: 424 - RNA, 19 nt, Artificial Sequence
  Description of Artificial Sequence: Synthetic oligonucleotide
ggacccagcucagugagcu

SEQ ID NO: 425 - RNA, 19 nt, Artificial Sequence
  Description of Artificial Sequence: Synthetic oligonucleotide
ccaaugacauuuuguugga

SEQ ID NO: 426 - RNA, 19 nt, Artificial Sequence
  Description of Artificial Sequence: Synthetic oligonucleotide
agugaggcggauugagaag

SEQ ID NO: 427 - RNA, 19 nt, Artificial Sequence
  Description of Artificial Sequence: Synthetic oligonucleotide
ugcaguccaucaacgagug

SEQ ID NO: 428 - RNA, 19 nt, Artificial Sequence
  Description of Artificial Sequence: Synthetic oligonucleotide
ugucacgcaugucaggcaa

SEQ ID NO: 429 - RNA, 19 nt, Artificial Sequence
  Description of Artificial Sequence: Synthetic oligonucleotide
cgacgacgagaaggaaaag

SEQ ID NO: 430 - RNA, 19 nt, Artificial Sequence
  Description of Artificial Sequence: Synthetic oligonucleotide
acaagaacaaggccgacuu

SEQ ID NO: 431 - RNA, 19 nt, Artificial Sequence
  Description of Artificial Sequence: Synthetic oligonucleotide
cuucaagccacacugggau

SEQ ID NO: 432 - RNA, 19 nt, Artificial Sequence
  Description of Artificial Sequence: Synthetic oligonucleotide
ccugggccauagucauucu

SEQ ID NO: 433 - RNA, 19 nt, Artificial Sequence
  Description of Artificial Sequence: Synthetic oligonucleotide
uuuguuggagcguggaaaa

SEQ ID NO: 434 - RNA, 19 nt, Artificial Sequence
  Description of Artificial Sequence: Synthetic oligonucleotide
agaacauccuggugucacc

SEQ ID NO: 435 - RNA, 19 nt, Artificial Sequence
  Description of Artificial Sequence: Synthetic oligonucleotide
acgccaccgccuuugaguu

SEQ ID NO: 436 - RNA, 19 nt, Artificial Sequence
  Description of Artificial Sequence: Synthetic oligonucleotide
gugagguaccagccuugga

SEQ ID NO: 437 - RNA, 19 nt, Artificial Sequence
  Description of Artificial Sequence: Synthetic oligonucleotide
gcgccuucugccuccugga

SEQ ID NO: 438 - RNA, 19 nt, Artificial Sequence
  Description of Artificial Sequence: Synthetic oligonucleotide
gccuggccuucagcuugua

SEQ ID NO: 439 - RNA, 19 nt, Artificial Sequence
  Description of Artificial Sequence: Synthetic oligonucleotide
cccggaaacuccacauccu

SEQ ID NO: 440 - RNA, 19 nt, Artificial Sequence
  Description of Artificial Sequence: Synthetic oligonucleotide
ucuucaagccacacuggga

SEQ ID NO: 441 - RNA, 19 nt, Artificial Sequence
  Description of Artificial Sequence: Synthetic oligonucleotide
uguugcuaucaauccaaga

SEQ ID NO: 442 - RNA, 19 nt, Artificial Sequence
  Description of Artificial Sequence: Synthetic oligonucleotide
gagugggccgcgcagacca

SEQ ID NO: 443 - RNA, 19 nt, Artificial Sequence
  Description of Artificial Sequence: Synthetic oligonucleotide
ccugagacacaugggugcu

SEQ ID NO: 444 - RNA, 19 nt, Artificial Sequence
  Description of Artificial Sequence: Synthetic oligonucleotide
agccgacuguacggaccca

SEQ ID NO: 445 - RNA, 19 nt, Artificial Sequence
  Description of Artificial Sequence: Synthetic oligonucleotide
gggccucagggugcacaca

SEQ ID NO: 446 - RNA, 19 nt, Artificial Sequence
  Description of Artificial Sequence: Synthetic oligonucleotide
acugggaugagaaauucca

SEQ ID NO: 447 - RNA, 19 nt, Artificial Sequence
  Description of Artificial Sequence: Synthetic oligonucleotide
agaaugaccuggccgcagu

SEQ ID NO: 448 - RNA, 19 nt, Artificial Sequence
  Description of Artificial Sequence: Synthetic oligonucleotide
cauauuuauagccagguac

SEQ ID NO: 449 - RNA, 19 nt, Artificial Sequence
  Description of Artificial Sequence: Synthetic oligonucleotide
aggugacccaugaccugca

SEQ ID NO: 450 - RNA, 19 nt, Artificial Sequence
  Description of Artificial Sequence: Synthetic oligonucleotide
gcgcugcaguccaucaacg

SEQ ID NO: 451 - RNA, 19 nt, Artificial Sequence
  Description of Artificial Sequence: Synthetic oligonucleotide
ggugacaagaugcgagacg

SEQ ID NO: 452 - RNA, 19 nt, Artificial Sequence
  Description of Artificial Sequence: Synthetic oligonucleotide
cuucaaagauagggaggga

SEQ ID NO: 453 - RNA, 19 nt, Artificial Sequence
  Description of Artificial Sequence: Synthetic oligonucleotide
agcugcaaaucguggagau

SEQ ID NO: 454 - RNA, 19 nt, Artificial Sequence
  Description of Artificial Sequence: Synthetic oligonucleotide
guggagaacauccuggugu

SEQ ID NO: 455 - RNA, 19 nt, Artificial Sequence
  Description of Artificial Sequence: Synthetic oligonucleotide
gaacaaggccgacuuguca

SEQ ID NO: 456 - RNA, 19 nt, Artificial Sequence
  Description of Artificial Sequence: Synthetic oligonucleotide
caugaugcugagcccggaa

SEQ ID NO: 457 - RNA, 19 nt, Artificial Sequence
  Description of Artificial Sequence: Synthetic oligonucleotide
gcgccuugaaaagcugcua

SEQ ID NO: 458 - RNA, 19 nt, Artificial Sequence
  Description of Artificial Sequence: Synthetic oligonucleotide
gcagacucuggucaagaag

SEQ ID NO: 459 - RNA, 19 nt, Artificial Sequence
  Description of Artificial Sequence: Synthetic oligonucleotide
ccaggcaguggagaacauc

SEQ ID NO: 460 - RNA, 19 nt, Artificial Sequence
  Description of Artificial Sequence: Synthetic oligonucleotide
uucuugaccagagucugcc

SEQ ID NO: 461 - RNA, 19 nt, Artificial Sequence
  Description of Artificial Sequence: Synthetic oligonucleotide
uucucaauccgccucacug

SEQ ID NO: 462 - RNA, 19 nt, Artificial Sequence
  Description of Artificial Sequence: Synthetic oligonucleotide
auugauagcaacaaaggcu

SEQ ID NO: 463 - RNA, 19 nt, Artificial Sequence
  Description of Artificial Sequence: Synthetic oligonucleotide
uguggcuugaagaacaugg

SEQ ID NO: 464 - RNA, 19 nt, Artificial Sequence
  Description of Artificial Sequence: Synthetic oligonucleotide
uuuuagugucagaagaggg

SEQ ID NO: 465 - RNA, 19 nt, Artificial Sequence
  Description of Artificial Sequence: Synthetic oligonucleotide
auaugaauacugauugagg

SEQ ID NO: 466 - RNA, 19 nt, Artificial Sequence
  Description of Artificial Sequence: Synthetic oligonucleotide
aauagcacccaugugucuc

SEQ ID NO: 467 - RNA, 19 nt, Artificial Sequence
  Description of Artificial Sequence: Synthetic oligonucleotide
ucgucucgcaucuugucac

SEQ ID NO: 468 - RNA, 19 nt, Artificial Sequence
  Description of Artificial Sequence: Synthetic oligonucleotide
uuucucaucccaguguggc

SEQ ID NO: 469 - RNA, 19 nt, Artificial Sequence
  Description of Artificial Sequence: Synthetic oligonucleotide
uauaacucgucucgcaucu

SEQ ID NO: 470 - RNA, 19 nt, Artificial Sequence
  Description of Artificial Sequence: Synthetic oligonucleotide
uuuuccuucucgucgucgu

SEQ ID NO: 471 - RNA, 19 nt, Artificial Sequence
  Description of Artificial Sequence: Synthetic oligonucleotide
ucguaguaguuguagaggc

SEQ ID NO: 472 - RNA, 19 nt, Artificial Sequence
  Description of Artificial Sequence: Synthetic oligonucleotide
uugucgcggaaguugaucu

SEQ ID NO: 473 - RNA, 19 nt, Artificial Sequence
  Description of Artificial Sequence: Synthetic oligonucleotide
uucucgucgucguaguagu

SEQ ID NO: 474 - RNA, 19 nt, Artificial Sequence
  Description of Artificial Sequence: Synthetic oligonucleotide
uuagugucagaagagggcu

SEQ ID NO: 475 - RNA, 19 nt, Artificial Sequence
  Description of Artificial Sequence: Synthetic oligonucleotide
aacucgucucgcaucuugu

SEQ ID NO: 476 - RNA, 19 nt, Artificial Sequence
  Description of Artificial Sequence: Synthetic oligonucleotide
uucucaucccaguguggcu

SEQ ID NO: 477 - RNA, 19 nt, Artificial Sequence
  Description of Artificial Sequence: Synthetic oligonucleotide
uucuccacugccugguccu

SEQ ID NO: 478 - RNA, 19 nt, Artificial Sequence
  Description of Artificial Sequence: Synthetic oligonucleotide
uacagguccuucuugccug

SEQ ID NO: 479 - RNA, 19 nt, Artificial Sequence
  Description of Artificial Sequence: Synthetic oligonucleotide
ucaauuuggucucacaggu

SEQ ID NO: 480 - RNA, 19 nt, Artificial Sequence
  Description of Artificial Sequence: Synthetic oligonucleotide
uggauugauagcaacaaag

SEQ ID NO: 481 - RNA, 19 nt, Artificial Sequence
  Description of Artificial Sequence: Synthetic oligonucleotide
uagcucaauuuggucucac

SEQ ID NO: 482 - RNA, 19 nt, Artificial Sequence
  Description of Artificial Sequence: Synthetic oligonucleotide
ugaucugggacuuucaggg

SEQ ID NO: 483 - RNA, 19 nt, Artificial Sequence
  Description of Artificial Sequence: Synthetic oligonucleotide
uagauguccuggucaaagg

SEQ ID NO: 484 - RNA, 19 nt, Artificial Sequence
  Description of Artificial Sequence: Synthetic oligonucleotide
uguucuccacugccugguc

SEQ ID NO: 485 - RNA, 19 nt, Artificial Sequence
  Description of Artificial Sequence: Synthetic oligonucleotide
uuccaggucacguugcgcg

SEQ ID NO: 486 - RNA, 19 nt, Artificial Sequence
  Description of Artificial Sequence: Synthetic oligonucleotide
uugugguggaauuucucau

SEQ ID NO: 487 - RNA, 19 nt, Artificial Sequence
  Description of Artificial Sequence: Synthetic oligonucleotide
ugcggcugcagguuucuuc

SEQ ID NO: 488 - RNA, 19 nt, Artificial Sequence
  Description of Artificial Sequence: Synthetic oligonucleotide
uuuucaaggcgcucgagag

SEQ ID NO: 489 - RNA, 19 nt, Artificial Sequence
  Description of Artificial Sequence: Synthetic oligonucleotide
caacaaaggcucauguucc

SEQ ID NO: 490 - RNA, 19 nt, Artificial Sequence
  Description of Artificial Sequence: Synthetic oligonucleotide
auuuggucucacaggugag

SEQ ID NO: 491 - RNA, 19 nt, Artificial Sequence
  Description of Artificial Sequence: Synthetic oligonucleotide
uuccuucucgucgucguag

SEQ ID NO: 492 - RNA, 19 nt, Artificial Sequence
  Description of Artificial Sequence: Synthetic oligonucleotide
uuguccaccaucuuguggu

SEQ ID NO: 493 - RNA, 19 nt, Artificial Sequence
  Description of Artificial Sequence: Synthetic oligonucleotide
aacuucuccgcagugccag

SEQ ID NO: 494 - RNA, 19 nt, Artificial Sequence
  Description of Artificial Sequence: Synthetic oligonucleotide
acacccacgguauaggacc

SEQ ID NO: 495 - RNA, 19 nt, Artificial Sequence
  Description of Artificial Sequence: Synthetic oligonucleotide
uauaguugggagagguugg

SEQ ID NO: 496 - RNA, 19 nt, Artificial Sequence
  Description of Artificial Sequence: Synthetic oligonucleotide
uuugcagcuuuuccuucuc

SEQ ID NO: 497 - RNA, 19 nt, Artificial Sequence
  Description of Artificial Sequence: Synthetic oligonucleotide
uucaaggcgcucgagaggc

SEQ ID NO: 498 - RNA, 19 nt, Artificial Sequence
  Description of Artificial Sequence: Synthetic oligonucleotide
uuguucuugucaauggccu

SEQ ID NO: 499 - RNA, 19 nt, Artificial Sequence
  Description of Artificial Sequence: Synthetic oligonucleotide
uuucugcaggucauggguc

SEQ ID NO: 500 - RNA, 19 nt, Artificial Sequence
  Description of Artificial Sequence: Synthetic oligonucleotide
uucuccgcagugccaggag

SEQ ID NO: 501 - RNA, 19 nt, Artificial Sequence
  Description of Artificial Sequence: Synthetic oligonucleotide
aguuguagaggccuguccg

SEQ ID NO: 502 - RNA, 19 nt, Artificial Sequence
  Description of Artificial Sequence: Synthetic oligonucleotide
ugugguggaauuucucauc

SEQ ID NO: 503 - RNA, 19 nt, Artificial Sequence
  Description of Artificial Sequence: Synthetic oligonucleotide
uucuugccugacaugcgug

SEQ ID NO: 504 - RNA, 19 nt, Artificial Sequence
  Description of Artificial Sequence: Synthetic oligonucleotide
uuuuauaguugggagaggu

SEQ ID NO: 505 - RNA, 19 nt, Artificial Sequence
  Description of Artificial Sequence: Synthetic oligonucleotide
auguucuccacugccuggu

SEQ ID NO: 506 - RNA, 19 nt, Artificial Sequence
  Description of Artificial Sequence: Synthetic oligonucleotide
aacaaaggcucauguuccc

SEQ ID NO: 507 - RNA, 19 nt, Artificial Sequence
  Description of Artificial Sequence: Synthetic oligonucleotide
uccaaguggagugaauucu

SEQ ID NO: 508 - RNA, 19 nt, Artificial Sequence
  Description of Artificial Sequence: Synthetic oligonucleotide
ucuugaccagagucugccc

SEQ ID NO: 509 - RNA, 19 nt, Artificial Sequence
  Description of Artificial Sequence: Synthetic oligonucleotide
auuugcagcuuuuccuucu

SEQ ID NO: 510 - RNA, 19 nt, Artificial Sequence
  Description of Artificial Sequence: Synthetic oligonucleotide
caggauguucuccacugcc

SEQ ID NO: 511 - RNA, 19 nt, Artificial Sequence
  Description of Artificial Sequence: Synthetic oligonucleotide
ugguggaauuucucauccc

SEQ ID NO: 512 - RNA, 19 nt, Artificial Sequence
  Description of Artificial Sequence: Synthetic oligonucleotide
ucggcguagaacagcuugg

SEQ ID NO: 513 - RNA, 19 nt, Artificial Sequence
  Description of Artificial Sequence: Synthetic oligonucleotide
uuguagaggccuguccggu

SEQ ID NO: 514 - RNA, 19 nt, Artificial Sequence
  Description of Artificial Sequence: Synthetic oligonucleotide
ugaauacugauugaggcag

SEQ ID NO: 515 - RNA, 19 nt, Artificial Sequence
  Description of Artificial Sequence: Synthetic oligonucleotide
uagugucagaagagggcug

SEQ ID NO: 516 - RNA, 19 nt, Artificial Sequence
  Description of Artificial Sequence: Synthetic oligonucleotide
augaggaugaugaggcugg

SEQ ID NO: 517 - RNA, 19 nt, Artificial Sequence
  Description of Artificial Sequence: Synthetic oligonucleotide
ucucgcaucuugucacccu

SEQ ID NO: 518 - RNA, 19 nt, Artificial Sequence
  Description of Artificial Sequence: Synthetic oligonucleotide
guucuccacugccuggucc

SEQ ID NO: 519 - RNA, 19 nt, Artificial Sequence
  Description of Artificial Sequence: Synthetic oligonucleotide
auggacugcagcgcgcugc

SEQ ID NO: 520 - RNA, 19 nt, Artificial Sequence
  Description of Artificial Sequence: Synthetic oligonucleotide
uugauggacugcagcgcgc

SEQ ID NO: 521 - RNA, 19 nt, Artificial Sequence
  Description of Artificial Sequence: Synthetic oligonucleotide
ucagcaucaugguaucugg

SEQ ID NO: 522 - RNA, 19 nt, Artificial Sequence
  Description of Artificial Sequence: Synthetic oligonucleotide
uuugggugucccgcacuag

SEQ ID NO: 523 - RNA, 19 nt, Artificial Sequence
  Description of Artificial Sequence: Synthetic oligonucleotide
aggauguucuccacugccu

SEQ ID NO: 524 - RNA, 19 nt, Artificial Sequence
  Description of Artificial Sequence: Synthetic oligonucleotide
uagcacccaugugucucag

SEQ ID NO: 525 - RNA, 19 nt, Artificial Sequence
  Description of Artificial Sequence: Synthetic oligonucleotide
ugggagcuccuucucaauc

SEQ ID NO: 526 - RNA, 19 nt, Artificial Sequence
  Description of Artificial Sequence: Synthetic oligonucleotide
uugccgucgguggucugcg

SEQ ID NO: 527 - RNA, 19 nt, Artificial Sequence
  Description of Artificial Sequence: Synthetic oligonucleotide
auuucucaucccagugugg

SEQ ID NO: 528 - RNA, 19 nt, Artificial Sequence
  Description of Artificial Sequence: Synthetic oligonucleotide
ucagcgaagcucacugagc

SEQ ID NO: 529 - RNA, 19 nt, Artificial Sequence
  Description of Artificial Sequence: Synthetic oligonucleotide
uguguccaacucaaaggcg

SEQ ID NO: 530 - RNA, 19 nt, Artificial Sequence
  Description of Artificial Sequence: Synthetic oligonucleotide
gaagagggcuggcugaccc

SEQ ID NO: 531 - RNA, 19 nt, Artificial Sequence
  Description of Artificial Sequence: Synthetic oligonucleotide
agagucugcccagaagccc

SEQ ID NO: 532 - RNA, 19 nt, Artificial Sequence
  Description of Artificial Sequence: Synthetic oligonucleotide
ucacaggugagaagguacc

SEQ ID NO: 533 - RNA, 19 nt, Artificial Sequence
  Description of Artificial Sequence: Synthetic oligonucleotide
aauacugauugaggcaggc

SEQ ID NO: 534 - RNA, 19 nt, Artificial Sequence
  Description of Artificial Sequence: Synthetic oligonucleotide
ucgucguaguaguuguaga

SEQ ID NO: 535 - RNA, 19 nt, Artificial Sequence
  Description of Artificial Sequence: Synthetic oligonucleotide
ccuucuucugcaucuuccc

SEQ ID NO: 536 - RNA, 19 nt, Artificial Sequence
  Description of Artificial Sequence: Synthetic oligonucleotide
uugcagcuuuuccuucucg

SEQ ID NO: 537 - RNA, 19 nt, Artificial Sequence
  Description of Artificial Sequence: Synthetic oligonucleotide
auggcaacagccuucuucu

SEQ ID NO: 538 - RNA, 19 nt, Artificial Sequence
  Description of Artificial Sequence: Synthetic oligonucleotide
ugaggcuggagagcuugug

SEQ ID NO: 539 - RNA, 19 nt, Artificial Sequence
  Description of Artificial Sequence: Synthetic oligonucleotide
gucucgcaucuugucaccc

SEQ ID NO: 540 - RNA, 19 nt, Artificial Sequence
  Description of Artificial Sequence: Synthetic oligonucleotide
uuuuuuccacgcuccaaca

SEQ ID NO: 541 - RNA, 19 nt, Artificial Sequence
  Description of Artificial Sequence: Synthetic oligonucleotide
aucuguguccaacucaaag

SEQ ID NO: 542 - RNA, 19 nt, Artificial Sequence
  Description of Artificial Sequence: Synthetic oligonucleotide
augaugaggcuggagagcu

SEQ ID NO: 543 - RNA, 19 nt, Artificial Sequence
  Description of Artificial Sequence: Synthetic oligonucleotide
uggucggcguagaacagcu

SEQ ID NO: 544 - RNA, 19 nt, Artificial Sequence
  Description of Artificial Sequence: Synthetic oligonucleotide
acucguugauggacugcag

SEQ ID NO: 545 - RNA, 19 nt, Artificial Sequence
  Description of Artificial Sequence: Synthetic oligonucleotide
uuuccuucucgucgucgua

SEQ ID NO: 546 - RNA, 19 nt, Artificial Sequence
  Description of Artificial Sequence: Synthetic oligonucleotide
uugggugucccgcacuagg

SEQ ID NO: 547 - RNA, 19 nt, Artificial Sequence
  Description of Artificial Sequence: Synthetic oligonucleotide
uggucucacaggugagaag

SEQ ID NO: 548 - RNA, 19 nt, Artificial Sequence
  Description of Artificial Sequence: Synthetic oligonucleotide
uugccaucuguguccaacu

SEQ ID NO: 549 - RNA, 19 nt, Artificial Sequence
  Description of Artificial Sequence: Synthetic oligonucleotide
accaggauguucuccacug

SEQ ID NO: 550 - RNA, 19 nt, Artificial Sequence
  Description of Artificial Sequence: Synthetic oligonucleotide
uggagugaauucuagcugg

SEQ ID NO: 551 - RNA, 19 nt, Artificial Sequence
  Description of Artificial Sequence: Synthetic oligonucleotide
ucguugauggacugcagcg

SEQ ID NO: 552 - RNA, 19 nt, Artificial Sequence
  Description of Artificial Sequence: Synthetic oligonucleotide
uccacugccugguccuugg

SEQ ID NO: 553 - RNA, 19 nt, Artificial Sequence
  Description of Artificial Sequence: Synthetic oligonucleotide
ucccuaucuuugaagaacu

SEQ ID NO: 554 - RNA, 19 nt, Artificial Sequence
  Description of Artificial Sequence: Synthetic oligonucleotide
uucuagcugggaagguccg

SEQ ID NO: 555 - RNA, 19 nt, Artificial Sequence
  Description of Artificial Sequence: Synthetic oligonucleotide
acucgucucgcaucuuguc

SEQ ID NO: 556 - RNA, 19 nt, Artificial Sequence
  Description of Artificial Sequence: Synthetic oligonucleotide
ucgcggaaguugaucuugg

SEQ ID NO: 557 - RNA, 19 nt, Artificial Sequence
  Description of Artificial Sequence: Synthetic oligonucleotide
agaggcuccacgugauggg

SEQ ID NO: 558 - RNA, 19 nt, Artificial Sequence
  Description of Artificial Sequence: Synthetic oligonucleotide
uccgggcucagcaucaugg

SEQ ID NO: 559 - RNA, 19 nt, Artificial Sequence
  Description of Artificial Sequence: Synthetic oligonucleotide
auacugauugaggcaggcu

SEQ ID NO: 560 - RNA, 19 nt, Artificial Sequence
  Description of Artificial Sequence: Synthetic oligonucleotide
ucuugucacccuuaggccg

SEQ ID NO: 561 - RNA, 19 nt, Artificial Sequence
  Description of Artificial Sequence: Synthetic oligonucleotide
aauggccucagucaggccc

SEQ ID NO: 562 - RNA, 19 nt, Artificial Sequence
  Description of Artificial Sequence: Synthetic oligonucleotide
aauuuggucucacagguga

SEQ ID NO: 563 - RNA, 19 nt, Artificial Sequence
  Description of Artificial Sequence: Synthetic oligonucleotide
uguucuugucaauggccuc

SEQ ID NO: 564 - RNA, 19 nt, Artificial Sequence
  Description of Artificial Sequence: Synthetic oligonucleotide
ucuccgcagugccaggagc

SEQ ID NO: 565 - RNA, 19 nt, Artificial Sequence
  Description of Artificial Sequence: Synthetic oligonucleotide
uuaggccggaccaggcgcc

SEQ ID NO: 566 - RNA, 19 nt, Artificial Sequence
  Description of Artificial Sequence: Synthetic oligonucleotide
agugucagaagagggcugg

SEQ ID NO: 567 - RNA, 19 nt, Artificial Sequence
  Description of Artificial Sequence: Synthetic oligonucleotide
uccuucucgucgucguagu

SEQ ID NO: 568 - RNA, 19 nt, Artificial Sequence
  Description of Artificial Sequence: Synthetic oligonucleotide
augacacccacgguauagg

SEQ ID NO: 569 - RNA, 19 nt, Artificial Sequence
  Description of Artificial Sequence: Synthetic oligonucleotide
aagcucacugagcuggguc

SEQ ID NO: 570 - RNA, 19 nt, Artificial Sequence
  Description of Artificial Sequence: Synthetic oligonucleotide
ugcaucaucaugacaccca

SEQ ID NO: 571 - RNA, 19 nt, Artificial Sequence
  Description of Artificial Sequence: Synthetic oligonucleotide
accuccaccacacccuugg

SEQ ID NO: 572 - RNA, 19 nt, Artificial Sequence
  Description of Artificial Sequence: Synthetic oligonucleotide
uccacguccuuggugaccu

SEQ ID NO: 573 - RNA, 19 nt, Artificial Sequence
  Description of Artificial Sequence: Synthetic oligonucleotide
uucaccucggcggccaggg

SEQ ID NO: 574 - RNA, 19 nt, Artificial Sequence
  Description of Artificial Sequence: Synthetic oligonucleotide
aaguugaucuuggagugcu

SEQ ID NO: 575 - RNA, 19 nt, Artificial Sequence
  Description of Artificial Sequence: Synthetic oligonucleotide
acuucuccgcagugccagg

SEQ ID NO: 576 - RNA, 19 nt, Artificial Sequence
  Description of Artificial Sequence: Synthetic oligonucleotide
aacagccuucuucugcauc

SEQ ID NO: 577 - RNA, 19 nt, Artificial Sequence
  Description of Artificial Sequence: Synthetic oligonucleotide
aggcuggagagcuuguggg

SEQ ID NO: 578 - RNA, 19 nt, Artificial Sequence
  Description of Artificial Sequence: Synthetic oligonucleotide
uguuuuagugucagaagag

SEQ ID NO: 579 - RNA, 19 nt, Artificial Sequence
  Description of Artificial Sequence: Synthetic oligonucleotide
ugcagcuuuuccuucucgu

SEQ ID NO: 580 - RNA, 19 nt, Artificial Sequence
  Description of Artificial Sequence: Synthetic oligonucleotide
uuugguuagcagcuuuuca

SEQ ID NO: 581 - RNA, 19 nt, Artificial Sequence
  Description of Artificial Sequence: Synthetic oligonucleotide
uuuggucucacaggugaga

SEQ ID NO: 582 - RNA, 19 nt, Artificial Sequence
  Description of Artificial Sequence: Synthetic oligonucleotide
uguccggugcaucaucaug

SEQ ID NO: 583 - RNA, 19 nt, Artificial Sequence
  Description of Artificial Sequence: Synthetic oligonucleotide
gggagcuccuucucaaucc

SEQ ID NO: 584 - RNA, 19 nt, Artificial Sequence
  Description of Artificial Sequence: Synthetic oligonucleotide
cgcacuaggaagaugaagg

SEQ ID NO: 585 - RNA, 19 nt, Artificial Sequence
  Description of Artificial Sequence: Synthetic oligonucleotide
acaagcugaaggccaggcc

SEQ ID NO: 586 - RNA, 19 nt, Artificial Sequence
  Description of Artificial Sequence: Synthetic oligonucleotide
agaagagggcuggcugacc

SEQ ID NO: 587 - RNA, 19 nt, Artificial Sequence
  Description of Artificial Sequence: Synthetic oligonucleotide
uuggucucacaggugagaa

SEQ ID NO: 588 - RNA, 19 nt, Artificial Sequence
  Description of Artificial Sequence: Synthetic oligonucleotide
agugccaggagcugcugcg

SEQ ID NO: 589 - RNA, 19 nt, Artificial Sequence
  Description of Artificial Sequence: Synthetic oligonucleotide
guggcuugaagaacauggc

SEQ ID NO: 590 - RNA, 19 nt, Artificial Sequence
  Description of Artificial Sequence: Synthetic oligonucleotide
ucggcgcucagcacugccu

SEQ ID NO: 591 - RNA, 19 nt, Artificial Sequence
  Description of Artificial Sequence: Synthetic oligonucleotide
caauuuggucucacaggug

SEQ ID NO: 592 - RNA, 19 nt, Artificial Sequence
  Description of Artificial Sequence: Synthetic oligonucleotide
uguagaggccuguccggug

SEQ ID NO: 593 - RNA, 19 nt, Artificial Sequence
  Description of Artificial Sequence: Synthetic oligonucleotide
aguggagugaauucuagcu

SEQ ID NO: 594 - RNA, 19 nt, Artificial Sequence
  Description of Artificial Sequence: Synthetic oligonucleotide
acagccuucuucugcaucu

SEQ ID NO: 595 - RNA, 19 nt, Artificial Sequence
  Description of Artificial Sequence: Synthetic oligonucleotide
auggcguugacuagcaggg

SEQ ID NO: 596 - RNA, 19 nt, Artificial Sequence
  Description of Artificial Sequence: Synthetic oligonucleotide
ucgucgucguaguaguugu

SEQ ID NO: 597 - RNA, 19 nt, Artificial Sequence
  Description of Artificial Sequence: Synthetic oligonucleotide
acccaugugucucaggagc

SEQ ID NO: 598 - RNA, 19 nt, Artificial Sequence
  Description of Artificial Sequence: Synthetic oligonucleotide
gacaccaggauguucucca

SEQ ID NO: 599 - RNA, 19 nt, Artificial Sequence
  Description of Artificial Sequence: Synthetic oligonucleotide
ugauggacugcagcgcgcu

SEQ ID NO: 600 - RNA, 19 nt, Artificial Sequence
  Description of Artificial Sequence: Synthetic oligonucleotide
uuagcagcuuuucaaggcg

SEQ ID NO: 601 - RNA, 19 nt, Artificial Sequence
  Description of Artificial Sequence: Synthetic oligonucleotide
gauugauagcaacaaaggc

SEQ ID NO: 602 - RNA, 19 nt, Artificial Sequence
  Description of Artificial Sequence: Synthetic oligonucleotide
cgucguaguaguuguagag

SEQ ID NO: 603 - RNA, 19 nt, Artificial Sequence
  Description of Artificial Sequence: Synthetic oligonucleotide
uggaguugcugagugagcg

SEQ ID NO: 604 - RNA, 19 nt, Artificial Sequence
  Description of Artificial Sequence: Synthetic oligonucleotide
aguauccaaggcugguacc

SEQ ID NO: 605 - RNA, 19 nt, Artificial Sequence
  Description of Artificial Sequence: Synthetic oligonucleotide
ucaauggccucagucaggc

SEQ ID NO: 606 - RNA, 19 nt, Artificial Sequence
  Description of Artificial Sequence: Synthetic oligonucleotide
aagucaucagcgaagcuca

SEQ ID NO: 607 - RNA, 19 nt, Artificial Sequence
  Description of Artificial Sequence: Synthetic oligonucleotide
auggaguauccaaggcugg

SEQ ID NO: 608 - RNA, 19 nt, Artificial Sequence
  Description of Artificial Sequence: Synthetic oligonucleotide
augugucucaggagccuuu

SEQ ID NO: 609 - RNA, 19 nt, Artificial Sequence
  Description of Artificial Sequence: Synthetic oligonucleotide
uucugcaggucauggguca

SEQ ID NO: 610 - RNA, 19 nt, Artificial Sequence
  Description of Artificial Sequence: Synthetic oligonucleotide
cucaauuuggucucacagg

SEQ ID NO: 611 - RNA, 19 nt, Artificial Sequence
  Description of Artificial Sequence: Synthetic oligonucleotide
ucuagcugggaagguccgc

SEQ ID NO: 612 - RNA, 19 nt, Artificial Sequence
  Description of Artificial Sequence: Synthetic oligonucleotide
gccuucuucugcaucuucc

SEQ ID NO: 613 - RNA, 19 nt, Artificial Sequence
  Description of Artificial Sequence: Synthetic oligonucleotide
uccaccacacccuugggca

SEQ ID NO: 614 - RNA, 19 nt, Artificial Sequence
  Description of Artificial Sequence: Synthetic oligonucleotide
aaggcgcucgagaggcucc

SEQ ID NO: 615 - RNA, 19 nt, Artificial Sequence
  Description of Artificial Sequence: Synthetic oligonucleotide
augcuucuugaccagaguc

SEQ ID NO: 616 - RNA, 19 nt, Artificial Sequence
  Description of Artificial Sequence: Synthetic oligonucleotide
ggauguucuccacugccug

SEQ ID NO: 617 - RNA, 19 nt, Artificial Sequence
  Description of Artificial Sequence: Synthetic oligonucleotide
acugauugaggcaggcuug

SEQ ID NO: 618 - RNA, 19 nt, Artificial Sequence
  Description of Artificial Sequence: Synthetic oligonucleotide
ucggcugcccagcuuccag

SEQ ID NO: 619 - RNA, 19 nt, Artificial Sequence
  Description of Artificial Sequence: Synthetic oligonucleotide
gauggcaacagccuucuuc

SEQ ID NO: 620 - RNA, 19 nt, Artificial Sequence
  Description of Artificial Sequence: Synthetic oligonucleotide
ugagcgcagcagcucgccc

SEQ ID NO: 621 - RNA, 19 nt, Artificial Sequence
  Description of Artificial Sequence: Synthetic oligonucleotide
ucucaucccaguguggcuu

SEQ ID NO: 622 - RNA, 19 nt, Artificial Sequence
  Description of Artificial Sequence: Synthetic oligonucleotide
ugggucaccuccaccacac

SEQ ID NO: 623 - RNA, 19 nt, Artificial Sequence
  Description of Artificial Sequence: Synthetic oligonucleotide
guguccaacucaaaggcgg

SEQ ID NO: 624 - RNA, 19 nt, Artificial Sequence
  Description of Artificial Sequence: Synthetic oligonucleotide
cuuguucuugucaauggcc

SEQ ID NO: 625 - RNA, 19 nt, Artificial Sequence
  Description of Artificial Sequence: Synthetic oligonucleotide
augaauacugauugaggca

SEQ ID NO: 626 - RNA, 19 nt, Artificial Sequence
  Description of Artificial Sequence: Synthetic oligonucleotide
ugaauucuagcugggaagg

SEQ ID NO: 627 - RNA, 19 nt, Artificial Sequence
  Description of Artificial Sequence: Synthetic oligonucleotide
ugacuauggcccagguccc

SEQ ID NO: 628 - RNA, 19 nt, Artificial Sequence
  Description of Artificial Sequence: Synthetic oligonucleotide
ugcagguuucuucaccucg

SEQ ID NO: 629 - RNA, 19 nt, Artificial Sequence
  Description of Artificial Sequence: Synthetic oligonucleotide
cuguguccaacucaaaggc

SEQ ID NO: 630 - RNA, 19 nt, Artificial Sequence
  Description of Artificial Sequence: Synthetic oligonucleotide
cuagcugggaagguccgcu

SEQ ID NO: 631 - RNA, 19 nt, Artificial Sequence
  Description of Artificial Sequence: Synthetic oligonucleotide
ccuucuugccugacaugcg

SEQ ID NO: 632 - RNA, 19 nt, Artificial Sequence
  Description of Artificial Sequence: Synthetic oligonucleotide
uuggagugcucgcaguugu

SEQ ID NO: 633 - RNA, 19 nt, Artificial Sequence
  Description of Artificial Sequence: Synthetic oligonucleotide
cuccuucucaauccgccuc

SEQ ID NO: 634 - RNA, 19 nt, Artificial Sequence
  Description of Artificial Sequence: Synthetic oligonucleotide
uuucuucaccucggcggcc

SEQ ID NO: 635 - RNA, 19 nt, Artificial Sequence
  Description of Artificial Sequence: Synthetic oligonucleotide
agagguugggauagagcug

SEQ ID NO: 636 - RNA, 19 nt, Artificial Sequence
  Description of Artificial Sequence: Synthetic oligonucleotide
uacagucggcugcccagcu

SEQ ID NO: 637 - RNA, 19 nt, Artificial Sequence
  Description of Artificial Sequence: Synthetic oligonucleotide
ccuuguucuugucaauggc

SEQ ID NO: 638 - RNA, 19 nt, Artificial Sequence
  Description of Artificial Sequence: Synthetic oligonucleotide
uggcuugaagaacauggcg

SEQ ID NO: 639 - RNA, 19 nt, Artificial Sequence
  Description of Artificial Sequence: Synthetic oligonucleotide
acguccuuggugaccucgg

SEQ ID NO: 640 - RNA, 19 nt, Artificial Sequence
  Description of Artificial Sequence: Synthetic oligonucleotide
agcucacugagcugggucc

SEQ ID NO: 641 - RNA, 19 nt, Artificial Sequence
  Description of Artificial Sequence: Synthetic oligonucleotide
uccaacaaaaugucauugg

SEQ ID NO: 642 - RNA, 19 nt, Artificial Sequence
  Description of Artificial Sequence: Synthetic oligonucleotide
cuucucaauccgccucacu

SEQ ID NO: 643 - RNA, 19 nt, Artificial Sequence
  Description of Artificial Sequence: Synthetic oligonucleotide
cacucguugauggacugca

SEQ ID NO: 644 - RNA, 19 nt, Artificial Sequence
  Description of Artificial Sequence: Synthetic oligonucleotide
uugccugacaugcgugaca

SEQ ID NO: 645 - RNA, 19 nt, Artificial Sequence
  Description of Artificial Sequence: Synthetic oligonucleotide
cuuuuccuucucgucgucg

SEQ ID NO: 646 - RNA, 19 nt, Artificial Sequence
  Description of Artificial Sequence: Synthetic oligonucleotide
aagucggccuuguucuugu

SEQ ID NO: 647 - RNA, 19 nt, Artificial Sequence
  Description of Artificial Sequence: Synthetic oligonucleotide
aucccaguguggcuugaag

SEQ ID NO: 648 - RNA, 19 nt, Artificial Sequence
  Description of Artificial Sequence: Synthetic oligonucleotide
agaaugacuauggcccagg

SEQ ID NO: 649 - RNA, 19 nt, Artificial Sequence
  Description of Artificial Sequence: Synthetic oligonucleotide
uuuuccacgcuccaacaaa

SEQ ID NO: 650 - RNA, 19 nt, Artificial Sequence
  Description of Artificial Sequence: Synthetic oligonucleotide
ggugacaccaggauguucu

SEQ ID NO: 651 - RNA, 19 nt, Artificial Sequence
  Description of Artificial Sequence: Synthetic oligonucleotide
aacucaaaggcgguggcgu

SEQ ID NO: 652 - RNA, 19 nt, Artificial Sequence
  Description of Artificial Sequence: Synthetic oligonucleotide
uccaaggcugguaccucac

SEQ ID NO: 653 - RNA, 19 nt, Artificial Sequence
  Description of Artificial Sequence: Synthetic oligonucleotide
uccaggaggcagaaggcgc

SEQ ID NO: 654 - RNA, 19 nt, Artificial Sequence
  Description of Artificial Sequence: Synthetic oligonucleotide
uacaagcugaaggccaggc

SEQ ID NO: 655 - RNA, 19 nt, Artificial Sequence
  Description of Artificial Sequence: Synthetic oligonucleotide
aggauguggaguuuccggg

SEQ ID NO: 656 - RNA, 19 nt, Artificial Sequence
  Description of Artificial Sequence: Synthetic oligonucleotide
ucccaguguggcuugaaga

SEQ ID NO: 657 - RNA, 19 nt, Artificial Sequence
  Description of Artificial Sequence: Synthetic oligonucleotide
ucuuggauugauagcaaca

SEQ ID NO: 658 - RNA, 19 nt, Artificial Sequence
  Description of Artificial Sequence: Synthetic oligonucleotide
uggucugcgcggcccacuc

SEQ ID NO: 659 - RNA, 19 nt, Artificial Sequence
  Description of Artificial Sequence: Synthetic oligonucleotide
agcacccaugugucucagg

SEQ ID NO: 660 - RNA, 19 nt, Artificial Sequence
  Description of Artificial Sequence: Synthetic oligonucleotide
uggguccguacagucggcu

SEQ ID NO: 661 - RNA, 19 nt, Artificial Sequence
  Description of Artificial Sequence: Synthetic oligonucleotide
ugugugcacccugaggccc

SEQ ID NO: 662 - RNA, 19 nt, Artificial Sequence
  Description of Artificial Sequence: Synthetic oligonucleotide
uggaauuucucaucccagu

SEQ ID NO: 663 - RNA, 19 nt, Artificial Sequence
  Description of Artificial Sequence: Synthetic oligonucleotide
acugcggccaggucauucu

SEQ ID NO: 664 - RNA, 19 nt, Artificial Sequence
  Description of Artificial Sequence: Synthetic oligonucleotide
guaccuggcuauaaauaug

SEQ ID NO: 665 - RNA, 19 nt, Artificial Sequence
  Description of Artificial Sequence: Synthetic oligonucleotide
ugcaggucaugggucaccu

SEQ ID NO: 666 - RNA, 19 nt, Artificial Sequence
  Description of Artificial Sequence: Synthetic oligonucleotide
cguugauggacugcagcgc

SEQ ID NO: 667 - RNA, 19 nt, Artificial Sequence
  Description of Artificial Sequence: Synthetic oligonucleotide
cgucucgcaucuugucacc

SEQ ID NO: 668 - RNA, 19 nt, Artificial Sequence
  Description of Artificial Sequence: Synthetic oligonucleotide
ucccucccuaucuuugaag

SEQ ID NO: 669 - RNA, 19 nt, Artificial Sequence
  Description of Artificial Sequence: Synthetic oligonucleotide
aucuccacgauuugcagcu

SEQ ID NO: 670 - RNA, 19 nt, Artificial Sequence
  Description of Artificial Sequence: Synthetic oligonucleotide
acaccaggauguucuccac

SEQ ID NO: 671 - RNA, 19 nt, Artificial Sequence
  Description of Artificial Sequence: Synthetic oligonucleotide
ugacaagucggccuuguuc

SEQ ID NO: 672 - RNA, 19 nt, Artificial Sequence
  Description of Artificial Sequence: Synthetic oligonucleotide
uuccgggcucagcaucaug

SEQ ID NO: 673 - RNA, 19 nt, Artificial Sequence
  Description of Artificial Sequence: Synthetic oligonucleotide
uagcagcuuuucaaggcgc

SEQ ID NO: 674 - RNA, 19 nt, Artificial Sequence
  Description of Artificial Sequence: Synthetic oligonucleotide
cuucuugaccagagucugc

SEQ ID NO: 675 - RNA, 19 nt, Artificial Sequence
  Description of Artificial Sequence: Synthetic oligonucleotide
gauguucuccacugccugg

SEQ ID NO: 676 - RNA, 19 nt, Artificial Sequence
  Description of Artificial Sequence: Synthetic oligonucleotide
cacuacaacugcgagcacu

SEQ ID NO: 677 - RNA, 19 nt, Artificial Sequence
  Description of Artificial Sequence: Synthetic oligonucleotide
aaccguggcuucaugguga

SEQ ID NO: 678 - RNA, 19 nt, Artificial Sequence
  Description of Artificial Sequence: Synthetic oligonucleotide
ggcaagaaggaccuguacc

SEQ ID NO: 679 - RNA, 19 nt, Artificial Sequence
  Description of Artificial Sequence: Synthetic oligonucleotide
gguggacaaccguggcuuc

SEQ ID NO: 680 - RNA, 19 nt, Artificial Sequence
  Description of Artificial Sequence: Synthetic oligonucleotide
aggccauggccaaggacca

SEQ ID NO: 681 - RNA, 19 nt, Artificial Sequence
  Description of Artificial Sequence: Synthetic oligonucleotide
cgcagcgcgcugcagucca

SEQ ID NO: 682 - RNA, 19 nt, Artificial Sequence
  Description of Artificial Sequence: Synthetic oligonucleotide
agcagcaagcagcacuaca

SEQ ID NO: 683 - RNA, 19 nt, Artificial Sequence
  Description of Artificial Sequence: Synthetic oligonucleotide
ggccucuacaacuacuacg

SEQ ID NO: 684 - RNA, 19 nt, Artificial Sequence
  Description of Artificial Sequence: Synthetic oligonucleotide
gaagaugcagaagaaggcu

SEQ ID NO: 685 - RNA, 19 nt, Artificial Sequence
  Description of Artificial Sequence: Synthetic oligonucleotide
ggcuccugagacacauggg

SEQ ID NO: 686 - RNA, 19 nt, Artificial Sequence
  Description of Artificial Sequence: Synthetic oligonucleotide
agcaagcagcacuacaacu

SEQ ID NO: 687 - RNA, 19 nt, Artificial Sequence
  Description of Artificial Sequence: Synthetic oligonucleotide
ggaggugacccaugaccug

SEQ ID NO: 688 - RNA, 19 nt, Artificial Sequence
  Description of Artificial Sequence: Synthetic oligonucleotide
cccuuugaccaggacaucu

SEQ ID NO: 689 - RNA, 19 nt, Artificial Sequence
  Description of Artificial Sequence: Synthetic oligonucleotide
cuccugagacacaugggug

SEQ ID NO: 690 - RNA, 19 nt, Artificial Sequence
  Description of Artificial Sequence: Synthetic oligonucleotide
aaggcuccugagacacaug

SEQ ID NO: 691 - RNA, 19 nt, Artificial Sequence
  Description of Artificial Sequence: Synthetic oligonucleotide
cgcgcugcaguccaucaac

SEQ ID NO: 692 - RNA, 19 nt, Artificial Sequence
  Description of Artificial Sequence: Synthetic oligonucleotide
agggugugguggaggugac

SEQ ID NO: 693 - RNA, 19 nt, Artificial Sequence
  Description of Artificial Sequence: Synthetic oligonucleotide
agcacuacaacugcgagca

SEQ ID NO: 694 - RNA, 19 nt, Artificial Sequence
  Description of Artificial Sequence: Synthetic oligonucleotide
ggcucccugcuauucauug

SEQ ID NO: 695 - RNA, 19 nt, Artificial Sequence
  Description of Artificial Sequence: Synthetic oligonucleotide
gcgcgcaacgugaccugga

SEQ ID NO: 696 - RNA, 19 nt, Artificial Sequence
  Description of Artificial Sequence: Synthetic oligonucleotide
gcugcaguccaucaacgag

SEQ ID NO: 697 - RNA, 19 nt, Artificial Sequence
  Description of Artificial Sequence: Synthetic oligonucleotide
accaaagagcagcugaaga

SEQ ID NO: 698 - RNA, 19 nt, Artificial Sequence
  Description of Artificial Sequence: Synthetic oligonucleotide
ccaaggacguggagcgcac

SEQ ID NO: 699 - RNA, 19 nt, Artificial Sequence
  Description of Artificial Sequence: Synthetic oligonucleotide
uguucuucaagccacacug

SEQ ID NO: 700 - RNA, 19 nt, Artificial Sequence
  Description of Artificial Sequence: Synthetic oligonucleotide
gcccaagggugugguggag

SEQ ID NO: 701 - RNA, 19 nt, Artificial Sequence
  Description of Artificial Sequence: Synthetic oligonucleotide
acaggccucuacaacuacu

SEQ ID NO: 702 - RNA, 19 nt, Artificial Sequence
  Description of Artificial Sequence: Synthetic oligonucleotide
ugcgcagcagcaagcagca

SEQ ID NO: 703 - RNA, 19 nt, Artificial Sequence
  Description of Artificial Sequence: Synthetic oligonucleotide
gguggaggugacccaugac

SEQ ID NO: 704 - RNA, 19 nt, Artificial Sequence
  Description of Artificial Sequence: Synthetic oligonucleotide
cuuugaccaggacaucuac

SEQ ID NO: 705 - RNA, 19 nt, Artificial Sequence
  Description of Artificial Sequence: Synthetic oligonucleotide
aagggugugguggagguga

SEQ ID NO: 706 - RNA, 19 nt, Artificial Sequence
  Description of Artificial Sequence: Synthetic oligonucleotide
uccuauaccguggguguca

SEQ ID NO: 707 - RNA, 19 nt, Artificial Sequence
  Description of Artificial Sequence: Synthetic oligonucleotide
gcgcagaccaccgacggca

SEQ ID NO: 708 - RNA, 19 nt, Artificial Sequence
  Description of Artificial Sequence: Synthetic oligonucleotide
cgcagcagcaagcagcacu

SEQ ID NO: 709 - RNA, 19 nt, Artificial Sequence
  Description of Artificial Sequence: Synthetic oligonucleotide
gccucaucauccucaugcc

SEQ ID NO: 710 - RNA, 19 nt, Artificial Sequence
  Description of Artificial Sequence: Synthetic oligonucleotide
ucuccagccucaucauccu

SEQ ID NO: 711 - RNA, 19 nt, Artificial Sequence
  Description of Artificial Sequence: Synthetic oligonucleotide
ccauugacaagaacaaggc

SEQ ID NO: 712 - RNA, 19 nt, Artificial Sequence
  Description of Artificial Sequence: Synthetic oligonucleotide
agcagcacuacaacugcga

SEQ ID NO: 713 - RNA, 19 nt, Artificial Sequence
  Description of Artificial Sequence: Synthetic oligonucleotide
ugcaccggacaggccucua

SEQ ID NO: 714 - RNA, 19 nt, Artificial Sequence
  Description of Artificial Sequence: Synthetic oligonucleotide
acuccaagaucaacuuccg

SEQ ID NO: 715 - RNA, 19 nt, Artificial Sequence
  Description of Artificial Sequence: Synthetic oligonucleotide
uggacaaccguggcuucau

SEQ ID NO: 716 - RNA, 19 nt, Artificial Sequence
  Description of Artificial Sequence: Synthetic oligonucleotide
gagcagcugaagaucugga

SEQ ID NO: 717 - RNA, 19 nt, Artificial Sequence
  Description of Artificial Sequence: Synthetic oligonucleotide
cagaagaaggcuguugcca

SEQ ID NO: 718 - RNA, 19 nt, Artificial Sequence
  Description of Artificial Sequence: Synthetic oligonucleotide
aggcaagaaggaccuguac

SEQ ID NO: 719 - RNA, 19 nt, Artificial Sequence
  Description of Artificial Sequence: Synthetic oligonucleotide
ccucuacaacuacuacgac

SEQ ID NO: 720 - RNA, 19 nt, Artificial Sequence
  Description of Artificial Sequence: Synthetic oligonucleotide
agcagcugaagaucuggau

SEQ ID NO: 721 - RNA, 19 nt, Artificial Sequence
  Description of Artificial Sequence: Synthetic oligonucleotide
aacuacuacgacgacgaga

SEQ ID NO: 722 - RNA, 19 nt, Artificial Sequence
  Description of Artificial Sequence: Synthetic oligonucleotide
ggcaagcugcccgagguca

SEQ ID NO: 723 - RNA, 19 nt, Artificial Sequence
  Description of Artificial Sequence: Synthetic oligonucleotide
ccggacaggccucuacaac

SEQ ID NO: 724 - RNA, 19 nt, Artificial Sequence
  Description of Artificial Sequence: Synthetic oligonucleotide
gcucccugcuauucauugg

SEQ ID NO: 725 - RNA, 19 nt, Artificial Sequence
  Description of Artificial Sequence: Synthetic oligonucleotide
aacugcgagcacuccaaga

SEQ ID NO: 726 - RNA, 19 nt, Artificial Sequence
  Description of Artificial Sequence: Synthetic oligonucleotide
gacacaugggugcuauugg

SEQ ID NO: 727 - RNA, 19 nt, Artificial Sequence
  Description of Artificial Sequence: Synthetic oligonucleotide
gcaccggacaggccucuac

SEQ ID NO: 728 - RNA, 19 nt, Artificial Sequence
  Description of Artificial Sequence: Synthetic oligonucleotide
agcgcagcgcgcugcaguc

SEQ ID NO: 729 - RNA, 19 nt, Artificial Sequence
  Description of Artificial Sequence: Synthetic oligonucleotide
ggacguggagcgcacggac

SEQ ID NO: 730 - RNA, 19 nt, Artificial Sequence
  Description of Artificial Sequence: Synthetic oligonucleotide
cagccucaucauccucaug

SEQ ID NO: 731 - RNA, 19 nt, Artificial Sequence
  Description of Artificial Sequence: Synthetic oligonucleotide
aagaucaacuuccgcgaca

SEQ ID NO: 732 - RNA, 19 nt, Artificial Sequence
  Description of Artificial Sequence: Synthetic oligonucleotide
gcgcaacgugaccuggaag

SEQ ID NO: 733 - RNA, 19 nt, Artificial Sequence
  Description of Artificial Sequence: Synthetic oligonucleotide
acugcgagcacuccaagau

SEQ ID NO: 734 - RNA, 19 nt, Artificial Sequence
  Description of Artificial Sequence: Synthetic oligonucleotide
guggacaaccguggcuuca

SEQ ID NO: 735 - RNA, 19 nt, Artificial Sequence
  Description of Artificial Sequence: Synthetic oligonucleotide
ccacaagcucuccagccuc

SEQ ID NO: 736 - RNA, 19 nt, Artificial Sequence
  Description of Artificial Sequence: Synthetic oligonucleotide
caagaugguggacaaccgu

SEQ ID NO: 737 - RNA, 19 nt, Artificial Sequence
  Description of Artificial Sequence: Synthetic oligonucleotide
cgagcacuccaagaucaac

SEQ ID NO: 738 - RNA, 19 nt, Artificial Sequence
  Description of Artificial Sequence: Synthetic oligonucleotide
agcugcccgaggucaccaa

SEQ ID NO: 739 - RNA, 19 nt, Artificial Sequence
  Description of Artificial Sequence: Synthetic oligonucleotide
ggacaucuacgggcgcgag

SEQ ID NO: 740 - RNA, 19 nt, Artificial Sequence
  Description of Artificial Sequence: Synthetic oligonucleotide
aggacaucuacgggcgcga

SEQ ID NO: 741 - RNA, 19 nt, Artificial Sequence
  Description of Artificial Sequence: Synthetic oligonucleotide
ugucaggcaagaaggaccu

SEQ ID NO: 742 - RNA, 19 nt, Artificial Sequence
  Description of Artificial Sequence: Synthetic oligonucleotide
gggugugguggaggugacc

SEQ ID NO: 743 - RNA, 19 nt, Artificial Sequence
  Description of Artificial Sequence: Synthetic oligonucleotide
caagcucuccagccucauc

SEQ ID NO: 744 - RNA, 19 nt, Artificial Sequence
  Description of Artificial Sequence: Synthetic oligonucleotide
gugacccaugaccugcaga

SEQ ID NO: 745 - RNA, 19 nt, Artificial Sequence
  Description of Artificial Sequence: Synthetic oligonucleotide
guucuucaagccacacugg

SEQ ID NO: 746 - RNA, 19 nt, Artificial Sequence
  Description of Artificial Sequence: Synthetic oligonucleotide
acaucuacgggcgcgagga

SEQ ID NO: 747 - RNA, 19 nt, Artificial Sequence
  Description of Artificial Sequence: Synthetic oligonucleotide
uggaggugacccaugaccu

SEQ ID NO: 748 - RNA, 19 nt, Artificial Sequence
  Description of Artificial Sequence: Synthetic oligonucleotide
ugcagaagaaggcuguugc

SEQ ID NO: 749 - RNA, 19 nt, Artificial Sequence
  Description of Artificial Sequence: Synthetic oligonucleotide
uguaccaggccauggccaa

SEQ ID NO: 750 - RNA, 19 nt, Artificial Sequence
  Description of Artificial Sequence: Synthetic oligonucleotide
ugugguggaggugacccau

SEQ ID NO: 751 - RNA, 19 nt, Artificial Sequence
  Description of Artificial Sequence: Synthetic oligonucleotide
agaaggaccuguaccuggc

SEQ ID NO: 752 - RNA, 19 nt, Artificial Sequence
  Description of Artificial Sequence: Synthetic oligonucleotide
agcagcugcgcgacgagga

SEQ ID NO: 753 - RNA, 19 nt, Artificial Sequence
  Description of Artificial Sequence: Synthetic oligonucleotide
acgccauguucuucaagcc

SEQ ID NO: 754 - RNA, 19 nt, Artificial Sequence
  Description of Artificial Sequence: Synthetic oligonucleotide
acaagaugguggacaaccg

SEQ ID NO: 755 - RNA, 19 nt, Artificial Sequence
  Description of Artificial Sequence: Synthetic oligonucleotide
cugcgagcacuccaagauc

SEQ ID NO: 756 - RNA, 19 nt, Artificial Sequence
  Description of Artificial Sequence: Synthetic oligonucleotide
gucacgcaugucaggcaag

SEQ ID NO: 757 - RNA, 19 nt, Artificial Sequence
  Description of Artificial Sequence: Synthetic oligonucleotide
acgcaugucaggcaagaag

SEQ ID NO: 758 - RNA, 19 nt, Artificial Sequence
  Description of Artificial Sequence: Synthetic oligonucleotide
ugcuauucauugggcgccu

SEQ ID NO: 759 - RNA, 19 nt, Artificial Sequence
  Description of Artificial Sequence: Synthetic oligonucleotide
ugcgcgacgaggaggugca

SEQ ID NO: 760 - RNA, 19 nt, Artificial Sequence
  Description of Artificial Sequence: Synthetic oligonucleotide
gcagcugaagaucuggaug

SEQ ID NO: 761 - RNA, 19 nt, Artificial Sequence
  Description of Artificial Sequence: Synthetic oligonucleotide
ccaugaccugcagaaacac

SEQ ID NO: 762 - RNA, 19 nt, Artificial Sequence
  Description of Artificial Sequence: Synthetic oligonucleotide
aagcucuccagccucauca

SEQ ID NO: 763 - RNA, 19 nt, Artificial Sequence
  Description of Artificial Sequence: Synthetic oligonucleotide
cagcaagcagcacuacaac

SEQ ID NO: 764 - RNA, 19 nt, Artificial Sequence
  Description of Artificial Sequence: Synthetic oligonucleotide
auguucuucaagccacacu

SEQ ID NO: 765 - RNA, 19 nt, Artificial Sequence
  Description of Artificial Sequence: Synthetic oligonucleotide
uccugagacacaugggugc

SEQ ID NO: 766 - RNA, 19 nt, Artificial Sequence
  Description of Artificial Sequence: Synthetic oligonucleotide
cacuccaagaucaacuucc

SEQ ID NO: 767 - RNA, 19 nt, Artificial Sequence
  Description of Artificial Sequence: Synthetic oligonucleotide
aagggugacaagaugcgag

SEQ ID NO: 768 - RNA, 19 nt, Artificial Sequence
  Description of Artificial Sequence: Synthetic oligonucleotide
gacaggccucuacaacuac

SEQ ID NO: 769 - RNA, 19 nt, Artificial Sequence
  Description of Artificial Sequence: Synthetic oligonucleotide
acccaugaccugcagaaac

SEQ ID NO: 770 - RNA, 19 nt, Artificial Sequence
  Description of Artificial Sequence: Synthetic oligonucleotide
caccacaagaugguggaca

SEQ ID NO: 771 - RNA, 19 nt, Artificial Sequence
  Description of Artificial Sequence: Synthetic oligonucleotide
gcagaagaaggcuguugcc

SEQ ID NO: 772 - RNA, 19 nt, Artificial Sequence
  Description of Artificial Sequence: Synthetic oligonucleotide
gugguggaggugacccaug

SEQ ID NO: 773 - RNA, 19 nt, Artificial Sequence
  Description of Artificial Sequence: Synthetic oligonucleotide
aggccucuacaacuacuac

SEQ ID NO: 774 - RNA, 19 nt, Artificial Sequence
  Description of Artificial Sequence: Synthetic oligonucleotide
ggugacccaugaccugcag

SEQ ID NO: 775 - RNA, 19 nt, Artificial Sequence
  Description of Artificial Sequence: Synthetic oligonucleotide
gccgaggugaagaaaccug

SEQ ID NO: 776 - RNA, 19 nt, Artificial Sequence
  Description of Artificial Sequence: Synthetic oligonucleotide
caacuacuacgacgacgag

SEQ ID NO: 777 - RNA, 19 nt, Artificial Sequence
  Description of Artificial Sequence: Synthetic oligonucleotide
caagaaggaccuguaccug

SEQ ID NO: 778 - RNA, 19 nt, Artificial Sequence
  Description of Artificial Sequence: Synthetic oligonucleotide
uguuccacgccaccgccuu

SEQ ID NO: 779 - RNA, 19 nt, Artificial Sequence
  Description of Artificial Sequence: Synthetic oligonucleotide
cccugcuauucauugggcg

SEQ ID NO: 780 - RNA, 19 nt, Artificial Sequence
  Description of Artificial Sequence: Synthetic oligonucleotide
ccguggcuucauggugacu

SEQ ID NO: 781 - RNA, 19 nt, Artificial Sequence
  Description of Artificial Sequence: Synthetic oligonucleotide
cuacaacuacuacgacgac

SEQ ID NO: 782 - RNA, 19 nt, Artificial Sequence
  Description of Artificial Sequence: Synthetic oligonucleotide
gcagcacuacaacugcgag

SEQ ID NO: 783 - RNA, 19 nt, Artificial Sequence
  Description of Artificial Sequence: Synthetic oligonucleotide
ugguggacaaccguggcuu

SEQ ID NO: 784 - RNA, 19 nt, Artificial Sequence
  Description of Artificial Sequence: Synthetic oligonucleotide
agaccaccgacggcaagcu

SEQ ID NO: 785 - RNA, 19 nt, Artificial Sequence
  Description of Artificial Sequence: Synthetic oligonucleotide
agaaacaccuggcugggcu

SEQ ID NO: 786 - RNA, 19 nt, Artificial Sequence
  Description of Artificial Sequence: Synthetic oligonucleotide
accaaggacguggagcgca

SEQ ID NO: 787 - RNA, 19 nt, Artificial Sequence
  Description of Artificial Sequence: Synthetic oligonucleotide
ccgaggugaagaaaccugc

SEQ ID NO: 788 - RNA, 19 nt, Artificial Sequence
  Description of Artificial Sequence: Synthetic oligonucleotide
acuacaacugcgagcacuc

SEQ ID NO: 789 - RNA, 19 nt, Artificial Sequence
  Description of Artificial Sequence: Synthetic oligonucleotide
acaagcucuccagccucau

SEQ ID NO: 790 - RNA, 19 nt, Artificial Sequence
  Description of Artificial Sequence: Synthetic oligonucleotide
aggacguggagcgcacgga

SEQ ID NO: 791 - RNA, 19 nt, Artificial Sequence
  Description of Artificial Sequence: Synthetic oligonucleotide
gcuauucauugggcgccug

SEQ ID NO: 792 - RNA, 19 nt, Artificial Sequence
  Description of Artificial Sequence: Synthetic oligonucleotide
aacuuccgcgacaagcgca

SEQ ID NO: 793 - RNA, 19 nt, Artificial Sequence
  Description of Artificial Sequence: Synthetic oligonucleotide
gcucuccagccucaucauc

SEQ ID NO: 794 - RNA, 19 nt, Artificial Sequence
  Description of Artificial Sequence: Synthetic oligonucleotide
agaaggcuguugccaucuc

SEQ ID NO: 795 - RNA, 19 nt, Artificial Sequence
  Description of Artificial Sequence: Synthetic oligonucleotide
ggucaccaaggacguggag

SEQ ID NO: 796 - RNA, 19 nt, Artificial Sequence
  Description of Artificial Sequence: Synthetic oligonucleotide
agcugcgcgacgaggaggu

SEQ ID NO: 797 - RNA, 19 nt, Artificial Sequence
  Description of Artificial Sequence: Synthetic oligonucleotide
cccgaggucaccaaggacg

SEQ ID NO: 798 - RNA, 19 nt, Artificial Sequence
  Description of Artificial Sequence: Synthetic oligonucleotide
augucaggcaagaaggacc

SEQ ID NO: 799 - RNA, 19 nt, Artificial Sequence
  Description of Artificial Sequence: Synthetic oligonucleotide
cgaggucaccaaggacgug

SEQ ID NO: 800 - RNA, 19 nt, Artificial Sequence
  Description of Artificial Sequence: Synthetic oligonucleotide
gaugcaccggacaggccuc

SEQ ID NO: 801 - RNA, 19 nt, Artificial Sequence
  Description of Artificial Sequence: Synthetic oligonucleotide
gcacuacaacugcgagcac

SEQ ID NO: 802 - RNA, 19 nt, Artificial Sequence
  Description of Artificial Sequence: Synthetic oligonucleotide
ccacaagaugguggacaac

SEQ ID NO: 803 - RNA, 19 nt, Artificial Sequence
  Description of Artificial Sequence: Synthetic oligonucleotide
caagggugugguggaggug

SEQ ID NO: 804 - RNA, 19 nt, Artificial Sequence
  Description of Artificial Sequence: Synthetic oligonucleotide
agcugaagaucuggauggg

SEQ ID NO: 805 - RNA, 19 nt, Artificial Sequence
  Description of Artificial Sequence: Synthetic oligonucleotide
accaggccauggccaagga

SEQ ID NO: 806 - RNA, 19 nt, Artificial Sequence
  Description of Artificial Sequence: Synthetic oligonucleotide
cauguucuucaagccacac

SEQ ID NO: 807 - RNA, 19 nt, Artificial Sequence
  Description of Artificial Sequence: Synthetic oligonucleotide
caagaucaacuuccgcgac

SEQ ID NO: 808 - RNA, 19 nt, Artificial Sequence
  Description of Artificial Sequence: Synthetic oligonucleotide
uccagccucaucauccuca

SEQ ID NO: 809 - RNA, 19 nt, Artificial Sequence
  Description of Artificial Sequence: Synthetic oligonucleotide
gcccgaggucaccaaggac

SEQ ID NO: 810 - RNA, 19 nt, Artificial Sequence
  Description of Artificial Sequence: Synthetic oligonucleotide
ucaagccacacugggauga

SEQ ID NO: 811 - RNA, 19 nt, Artificial Sequence
  Description of Artificial Sequence: Synthetic oligonucleotide
aguccaucaacgagugggc

SEQ ID NO: 812 - RNA, 19 nt, Artificial Sequence
  Description of Artificial Sequence: Synthetic oligonucleotide
gacuucgugcgcagcagca

SEQ ID NO: 813 - RNA, 19 nt, Artificial Sequence
  Description of Artificial Sequence: Synthetic oligonucleotide
cucuccagccucaucaucc

SEQ ID NO: 814 - RNA, 19 nt, Artificial Sequence
  Description of Artificial Sequence: Synthetic oligonucleotide
gcagaccaccgacggcaag

SEQ ID NO: 815 - RNA, 19 nt, Artificial Sequence
  Description of Artificial Sequence: Synthetic oligonucleotide
augcagaagaaggcuguug

SEQ ID NO: 816 - RNA, 19 nt, Artificial Sequence
  Description of Artificial Sequence: Synthetic oligonucleotide
caaccguggcuucauggug

SEQ ID NO: 817 - RNA, 19 nt, Artificial Sequence
  Description of Artificial Sequence: Synthetic oligonucleotide
uacuacgacgacgagaagg

SEQ ID NO: 818 - RNA, 19 nt, Artificial Sequence
  Description of Artificial Sequence: Synthetic oligonucleotide
gaaggcuguugccaucucc

SEQ ID NO: 819 - RNA, 19 nt, Artificial Sequence
  Description of Artificial Sequence: Synthetic oligonucleotide
ucaccaaggacguggagcg

SEQ ID NO: 820 - RNA, 19 nt, Artificial Sequence
  Description of Artificial Sequence: Synthetic oligonucleotide
cagcugaagaucuggaugg

SEQ ID NO: 821 - RNA, 19 nt, Artificial Sequence
  Description of Artificial Sequence: Synthetic oligonucleotide
ugggccugacugaggccau

SEQ ID NO: 822 - RNA, 19 nt, Artificial Sequence
  Description of Artificial Sequence: Synthetic oligonucleotide
accguggcuucauggugac

SEQ ID NO: 823 - RNA, 19 nt, Artificial Sequence
  Description of Artificial Sequence: Synthetic oligonucleotide
caguccaucaacgaguggg

SEQ ID NO: 824 - RNA, 19 nt, Artificial Sequence
  Description of Artificial Sequence: Synthetic oligonucleotide
ccgacggcaagcugcccga

SEQ ID NO: 825 - RNA, 19 nt, Artificial Sequence
  Description of Artificial Sequence: Synthetic oligonucleotide
acaagcgcagcgcgcugca

SEQ ID NO: 826 - RNA, 19 nt, Artificial Sequence
  Description of Artificial Sequence: Synthetic oligonucleotide
gaaacaccuggcugggcug

SEQ ID NO: 827 - RNA, 19 nt, Artificial Sequence
  Description of Artificial Sequence: Synthetic oligonucleotide
aggcuccugagacacaugg

SEQ ID NO: 828 - RNA, 19 nt, Artificial Sequence
  Description of Artificial Sequence: Synthetic oligonucleotide
caaggacguggagcgcacg

SEQ ID NO: 829 - RNA, 19 nt, Artificial Sequence
  Description of Artificial Sequence: Synthetic oligonucleotide
gcaguccaucaacgagugg

SEQ ID NO: 830 - RNA, 19 nt, Artificial Sequence
  Description of Artificial Sequence: Synthetic oligonucleotide
agaugguggacaaccgugg

SEQ ID NO: 831 - RNA, 19 nt, Artificial Sequence
  Description of Artificial Sequence: Synthetic oligonucleotide
aagcgcagcgcgcugcagu

SEQ ID NO: 832 - RNA, 19 nt, Artificial Sequence
  Description of Artificial Sequence: Synthetic oligonucleotide
caugucaggcaagaaggac

SEQ ID NO: 833 - RNA, 19 nt, Artificial Sequence
  Description of Artificial Sequence: Synthetic oligonucleotide
caagccacacugggaugag

SEQ ID NO: 834 - RNA, 19 nt, Artificial Sequence
  Description of Artificial Sequence: Synthetic oligonucleotide
aagaugcagaagaaggcug

SEQ ID NO: 835 - RNA, 19 nt, Artificial Sequence
  Description of Artificial Sequence: Synthetic oligonucleotide
ggccauggccaaggaccag

SEQ ID NO: 836 - RNA, 19 nt, Artificial Sequence
  Description of Artificial Sequence: Synthetic oligonucleotide
gugcgcagcagcaagcagc

SEQ ID NO: 837 - RNA, 19 nt, Artificial Sequence
  Description of Artificial Sequence: Synthetic oligonucleotide
caacugcgagcacuccaag

SEQ ID NO: 838 - RNA, 19 nt, Artificial Sequence
  Description of Artificial Sequence: Synthetic oligonucleotide
uacaacugcgagcacucca

SEQ ID NO: 839 - RNA, 19 nt, Artificial Sequence
  Description of Artificial Sequence: Synthetic oligonucleotide
cauugacaagaacaaggcc

SEQ ID NO: 840 - RNA, 19 nt, Artificial Sequence
  Description of Artificial Sequence: Synthetic oligonucleotide
caagcagcacuacaacugc

SEQ ID NO: 841 - RNA, 19 nt, Artificial Sequence
  Description of Artificial Sequence: Synthetic oligonucleotide
guguuccacgccaccgccu

SEQ ID NO: 842 - RNA, 19 nt, Artificial Sequence
  Description of Artificial Sequence: Synthetic oligonucleotide
ccugcuauucauugggcgc

SEQ ID NO: 843 - RNA, 19 nt, Artificial Sequence
  Description of Artificial Sequence: Synthetic oligonucleotide
gcccacaagcucuccagcc

SEQ ID NO: 844 - RNA, 19 nt, Artificial Sequence
  Description of Artificial Sequence: Synthetic oligonucleotide
cagcagcaagcagcacuac

SEQ ID NO: 845 - RNA, 19 nt, Artificial Sequence
  Description of Artificial Sequence: Synthetic oligonucleotide
ugaugcaccggacaggccu

SEQ ID NO: 846 - RNA, 19 nt, Artificial Sequence
  Description of Artificial Sequence: Synthetic oligonucleotide
ucaacuuccgcgacaagcg

SEQ ID NO: 847 - RNA, 19 nt, Artificial Sequence
  Description of Artificial Sequence: Synthetic oligonucleotide
ucaggcaagaaggaccugu

SEQ ID NO: 848 - RNA, 19 nt, Artificial Sequence
  Description of Artificial Sequence: Synthetic oligonucleotide
acuucgugcgcagcagcaa

SEQ ID NO: 849 - RNA, 19 nt, Artificial Sequence
  Description of Artificial Sequence: Synthetic oligonucleotide
acaaccguggcuucauggu

SEQ ID NO: 850 - RNA, 19 nt, Artificial Sequence
  Description of Artificial Sequence: Synthetic oligonucleotide
aaggcuguugccaucuccu

SEQ ID NO: 851 - RNA, 19 nt, Artificial Sequence
  Description of Artificial Sequence: Synthetic oligonucleotide
gcagcugcgcgacgaggag

SEQ ID NO: 852 - RNA, 19 nt, Artificial Sequence
  Description of Artificial Sequence: Synthetic oligonucleotide
uauucauugggcgccuggu

SEQ ID NO: 853 - RNA, 19 nt, Artificial Sequence
  Description of Artificial Sequence: Synthetic oligonucleotide
uccaccacaagauggugga

SEQ ID NO: 854 - RNA, 19 nt, Artificial Sequence
  Description of Artificial Sequence: Synthetic oligonucleotide
cccuggcccacaagcucuc

SEQ ID NO: 855 - RNA, 19 nt, Artificial Sequence
  Description of Artificial Sequence: Synthetic oligonucleotide
accaggacaucuacgggcg

SEQ ID NO: 856 - RNA, 19 nt, Artificial Sequence
  Description of Artificial Sequence: Synthetic oligonucleotide
gaugaugcaccggacaggc

SEQ ID NO: 857 - RNA, 19 nt, Artificial Sequence
  Description of Artificial Sequence: Synthetic oligonucleotide
caacgccauguucuucaag

SEQ ID NO: 858 - RNA, 19 nt, Artificial Sequence
  Description of Artificial Sequence: Synthetic oligonucleotide
acggcaagcugcccgaggu

SEQ ID NO: 859 - RNA, 19 nt, Artificial Sequence
  Description of Artificial Sequence: Synthetic oligonucleotide
cagcgcgcugcaguccauc

SEQ ID NO: 860 - RNA, 19 nt, Artificial Sequence
  Description of Artificial Sequence: Synthetic oligonucleotide
cccaagggugugguggagg

SEQ ID NO: 861 - RNA, 19 nt, Artificial Sequence
  Description of Artificial Sequence: Synthetic oligonucleotide
cauggccaaggaccaggca

SEQ ID NO: 862 - RNA, 19 nt, Artificial Sequence
  Description of Artificial Sequence: Synthetic oligonucleotide
cuccagccucaucauccuc

SEQ ID NO: 863 - RNA, 19 nt, Artificial Sequence
  Description of Artificial Sequence: Synthetic oligonucleotide
ucuacgggcgcgaggagcu

SEQ ID NO: 864 - RNA, 19 nt, Artificial Sequence
  Description of Artificial Sequence: Synthetic oligonucleotide
ggcccacaagcucuccagc

SEQ ID NO: 865 - RNA, 19 nt, Artificial Sequence
  Description of Artificial Sequence: Synthetic oligonucleotide
gucaggcaagaaggaccug

SEQ ID NO: 866 - RNA, 19 nt, Artificial Sequence
  Description of Artificial Sequence: Synthetic oligonucleotide
caucuacgggcgcgaggag

SEQ ID NO: 867 - RNA, 19 nt, Artificial Sequence
  Description of Artificial Sequence: Synthetic oligonucleotide
cgugcgcagcagcaagcag

SEQ ID NO: 868 - RNA, 19 nt, Artificial Sequence
  Description of Artificial Sequence: Synthetic oligonucleotide
agccucaucauccucaugc

SEQ ID NO: 869 - RNA, 19 nt, Artificial Sequence
  Description of Artificial Sequence: Synthetic oligonucleotide
uucaagccacacugggaug

SEQ ID NO: 870 - RNA, 19 nt, Artificial Sequence
  Description of Artificial Sequence: Synthetic oligonucleotide
aagaaggcuguugccaucu

SEQ ID NO: 871 - RNA, 19 nt, Artificial Sequence
  Description of Artificial Sequence: Synthetic oligonucleotide
ggugugguggaggugaccc

SEQ ID NO: 872 - RNA, 19 nt, Artificial Sequence
  Description of Artificial Sequence: Synthetic oligonucleotide
gaggugacccaugaccugc

SEQ ID NO: 873 - RNA, 19 nt, Artificial Sequence
  Description of Artificial Sequence: Synthetic oligonucleotide
guggaggugacccaugacc

SEQ ID NO: 874 - RNA, 19 nt, Artificial Sequence
  Description of Artificial Sequence: Synthetic oligonucleotide
cacaagaugguggacaacc

SEQ ID NO: 875 - RNA, 19 nt, Artificial Sequence
  Description of Artificial Sequence: Synthetic oligonucleotide
cuggcccacaagcucucca

SEQ ID NO: 876 - RNA, 19 nt, Artificial Sequence
  Description of Artificial Sequence: Synthetic oligonucleotide
gaugacuucgugcgcagca

SEQ ID NO: 877 - RNA, 19 nt, Artificial Sequence
  Description of Artificial Sequence: Synthetic oligonucleotide
acuuccgcgacaagcgcag

SEQ ID NO: 878 - RNA, 19 nt, Artificial Sequence
  Description of Artificial Sequence: Synthetic oligonucleotide
aacgccauguucuucaagc

SEQ ID NO: 879 - RNA, 19 nt, Artificial Sequence
  Description of Artificial Sequence: Synthetic oligonucleotide
ggaccuguaccuggccagc

SEQ ID NO: 880 - RNA, 19 nt, Artificial Sequence
  Description of Artificial Sequence: Synthetic oligonucleotide
gcgacgaggaggugcacgc

SEQ ID NO: 881 - RNA, 19 nt, Artificial Sequence
  Description of Artificial Sequence: Synthetic oligonucleotide
gcaagcugcccgaggucac

SEQ ID NO: 882 - RNA, 19 nt, Artificial Sequence
  Description of Artificial Sequence: Synthetic oligonucleotide
auucauugggcgccugguc

SEQ ID NO: 883 - RNA, 19 nt, Artificial Sequence
  Description of Artificial Sequence: Synthetic oligonucleotide
gaggucaccaaggacgugg

SEQ ID NO: 884 - RNA, 19 nt, Artificial Sequence
  Description of Artificial Sequence: Synthetic oligonucleotide
aagaaggaccuguaccugg

SEQ ID NO: 885 - RNA, 19 nt, Artificial Sequence
  Description of Artificial Sequence: Synthetic oligonucleotide
gacaaccguggcuucaugg

SEQ ID NO: 886 - RNA, 19 nt, Artificial Sequence
  Description of Artificial Sequence: Synthetic oligonucleotide
cugggccugacugaggcca

SEQ ID NO: 887 - RNA, 19 nt, Artificial Sequence
  Description of Artificial Sequence: Synthetic oligonucleotide
cuccaagaucaacuuccgc

SEQ ID NO: 888 - RNA, 19 nt, Artificial Sequence
  Description of Artificial Sequence: Synthetic oligonucleotide
caacuuccgcgacaagcgc

SEQ ID NO: 889 - RNA, 19 nt, Artificial Sequence
  Description of Artificial Sequence: Synthetic oligonucleotide
cucccugcuauucauuggg

SEQ ID NO: 890 - RNA, 19 nt, Artificial Sequence
  Description of Artificial Sequence: Synthetic oligonucleotide
aagcagcacuacaacugcg

SEQ ID NO: 891 - RNA, 19 nt, Artificial Sequence
  Description of Artificial Sequence: Synthetic oligonucleotide
gcgcagcagcaagcagcac

SEQ ID NO: 892 - RNA, 19 nt, Artificial Sequence
  Description of Artificial Sequence: Synthetic oligonucleotide
caggccauggccaaggacc

SEQ ID NO: 893 - RNA, 19 nt, Artificial Sequence
  Description of Artificial Sequence: Synthetic oligonucleotide
guaccaggccauggccaag

SEQ ID NO: 894 - RNA, 19 nt, Artificial Sequence
  Description of Artificial Sequence: Synthetic oligonucleotide
cuucgugcgcagcagcaag

SEQ ID NO: 895 - RNA, 19 nt, Artificial Sequence
  Description of Artificial Sequence: Synthetic oligonucleotide
cagcacuacaacugcgagc

SEQ ID NO: 896 - RNA, 19 nt, Artificial Sequence
  Description of Artificial Sequence: Synthetic oligonucleotide
uacaacuacuacgacgacg

SEQ ID NO: 897 - RNA, 19 nt, Artificial Sequence
  Description of Artificial Sequence: Synthetic oligonucleotide
gaugguggacaaccguggc

SEQ ID NO: 898 - RNA, 19 nt, Artificial Sequence
  Description of Artificial Sequence: Synthetic oligonucleotide
cuacaacugcgagcacucc

SEQ ID NO: 899 - RNA, 19 nt, Artificial Sequence
  Description of Artificial Sequence: Synthetic oligonucleotide
aaggaccuguaccuggcca

SEQ ID NO: 900 - RNA, 19 nt, Artificial Sequence
  Description of Artificial Sequence: Synthetic oligonucleotide
gcugcccgaggucaccaag

SEQ ID NO: 901 - RNA, 19 nt, Artificial Sequence
  Description of Artificial Sequence: Synthetic oligonucleotide
gacaucuacgggcgcgagg

SEQ ID NO: 902 - RNA, 19 nt, Artificial Sequence
  Description of Artificial Sequence: Synthetic oligonucleotide
ccaccacaagaugguggac

SEQ ID NO: 903 - RNA, 19 nt, Artificial Sequence
  Description of Artificial Sequence: Synthetic oligonucleotide
gcgcgacgaggaggugcac

SEQ ID NO: 904 - RNA, 19 nt, Artificial Sequence
  Description of Artificial Sequence: Synthetic oligonucleotide
cuauucauugggcgccugg

SEQ ID NO: 905 - RNA, 19 nt, Artificial Sequence
  Description of Artificial Sequence: Synthetic oligonucleotide
ccaggacaucuacgggcgc

SEQ ID NO: 906 - RNA, 19 nt, Artificial Sequence
  Description of Artificial Sequence: Synthetic oligonucleotide
aagaugguggacaaccgug

SEQ ID NO: 907 - RNA, 19 nt, Artificial Sequence
  Description of Artificial Sequence: Synthetic oligonucleotide
caggacaucuacgggcgcg

SEQ ID NO: 908 - RNA, 19 nt, Artificial Sequence
  Description of Artificial Sequence: Synthetic oligonucleotide
uccaagaucaacuuccgcg

SEQ ID NO: 909 - RNA, 19 nt, Artificial Sequence
  Description of Artificial Sequence: Synthetic oligonucleotide
gucaccaaggacguggagc

SEQ ID NO: 910 - RNA, 19 nt, Artificial Sequence
  Description of Artificial Sequence: Synthetic oligonucleotide
cugcccgaggucaccaagg

SEQ ID NO: 911 - RNA, 19 nt, Artificial Sequence
  Description of Artificial Sequence: Synthetic oligonucleotide
gaccaggacaucuacgggc

SEQ ID NO: 912 - RNA, 19 nt, Artificial Sequence
  Description of Artificial Sequence: Synthetic oligonucleotide
ccauggccaaggaccaggc

SEQ ID NO: 913 - RNA, 19 nt, Artificial Sequence
  Description of Artificial Sequence: Synthetic oligonucleotide
caccaaggacguggagcgc

SEQ ID NO: 914 - RNA, 19 nt, Artificial Sequence
  Description of Artificial Sequence: Synthetic oligonucleotide
gacaagcgcagcgcgcugc

SEQ ID NO: 915 - RNA, 19 nt, Artificial Sequence
  Description of Artificial Sequence: Synthetic oligonucleotide
caagcgcagcgcgcugcag

SEQ ID NO: 916 - RNA, 19 nt, Artificial Sequence
  Description of Artificial Sequence: Synthetic oligonucleotide
cagaccaccgacggcaagc

SEQ ID NO: 917 - RNA, 19 nt, Artificial Sequence
  Description of Artificial Sequence: Synthetic oligonucleotide
gaccaccgacggcaagcug

SEQ ID NO: 918 - RNA, 19 nt, Artificial Sequence
  Description of Artificial Sequence: Synthetic oligonucleotide
aggaccuguaccuggccag

SEQ ID NO: 919 - RNA, 19 nt, Artificial Sequence
  Description of Artificial Sequence: Synthetic oligonucleotide
cugcuauucauugggcgcc

SEQ ID NO: 920 - RNA, 19 nt, Artificial Sequence
  Description of Artificial Sequence: Synthetic oligonucleotide
ucauugggcgccugguccg

SEQ ID NO: 921 - RNA, 19 nt, Artificial Sequence
  Description of Artificial Sequence: Synthetic oligonucleotide
gcugcgcgacgaggaggug

SEQ ID NO: 922 - RNA, 19 nt, Artificial Sequence
  Description of Artificial Sequence: Synthetic oligonucleotide
cggcaagcugcccgagguc

SEQ ID NO: 923 - RNA, 19 nt, Artificial Sequence
  Description of Artificial Sequence: Synthetic oligonucleotide
ccucaucauccucaugccc

SEQ ID NO: 924 - RNA, 19 nt, Artificial Sequence
  Description of Artificial Sequence: Synthetic oligonucleotide
ccaggccauggccaaggac

SEQ ID NO: 925 - RNA, 19 nt, Artificial Sequence
  Description of Artificial Sequence: Synthetic oligonucleotide
gccauggccaaggaccagg

SEQ ID NO: 926 - RNA, 19 nt, Artificial Sequence
  Description of Artificial Sequence: Synthetic oligonucleotide
ccaccgacggcaagcugcc

SEQ ID NO: 927 - RNA, 19 nt, Artificial Sequence
  Description of Artificial Sequence: Synthetic oligonucleotide
augguggacaaccguggcu

SEQ ID NO: 928 - RNA, 19 nt, Artificial Sequence
  Description of Artificial Sequence: Synthetic oligonucleotide
cuuccgcgacaagcgcagc

SEQ ID NO: 929 - RNA, 19 nt, Artificial Sequence
  Description of Artificial Sequence: Synthetic oligonucleotide
cgcgacgaggaggugcacg

SEQ ID NO: 930 - RNA, 19 nt, Artificial Sequence
  Description of Artificial Sequence: Synthetic oligonucleotide
uggcccacaagcucuccag

SEQ ID NO: 931 - RNA, 19 nt, Artificial Sequence
  Description of Artificial Sequence: Synthetic oligonucleotide
gagcagcugcgcgacgagg

SEQ ID NO: 932 - RNA, 19 nt, Artificial Sequence
  Description of Artificial Sequence: Synthetic oligonucleotide
ugaccaggacaucuacggg

SEQ ID NO: 933 - RNA, 19 nt, Artificial Sequence
  Description of Artificial Sequence: Synthetic oligonucleotide
accaccgacggcaagcugc

SEQ ID NO: 934 - RNA, 19 nt, Artificial Sequence
  Description of Artificial Sequence: Synthetic oligonucleotide
gaaggaccuguaccuggcc

SEQ ID NO: 935 - RNA, 19 nt, Artificial Sequence
  Description of Artificial Sequence: Synthetic oligonucleotide
cauugggcgccugguccgg

SEQ ID NO: 936 - RNA, 19 nt, Artificial Sequence
  Description of Artificial Sequence: Synthetic oligonucleotide
augcaccggacaggccucu

SEQ ID NO: 937 - RNA, 19 nt, Artificial Sequence
  Description of Artificial Sequence: Synthetic oligonucleotide
aucaacuuccgcgacaagc

SEQ ID NO: 938 - RNA, 19 nt, Artificial Sequence
  Description of Artificial Sequence: Synthetic oligonucleotide
cagcugcgcgacgaggagg

SEQ ID NO: 939 - RNA, 19 nt, Artificial Sequence
  Description of Artificial Sequence: Synthetic oligonucleotide
cagaaacaccuggcugggc

SEQ ID NO: 940 - RNA, 19 nt, Artificial Sequence
  Description of Artificial Sequence: Synthetic oligonucleotide
cuacgggcgcgaggagcug

SEQ ID NO: 941 - RNA, 19 nt, Artificial Sequence
  Description of Artificial Sequence: Synthetic oligonucleotide
cgacgaggaggugcacgcc

SEQ ID NO: 942 - RNA, 19 nt, Artificial Sequence
  Description of Artificial Sequence: Synthetic oligonucleotide
uuugaccaggacaucuacg

SEQ ID NO: 943 - RNA, 19 nt, Artificial Sequence
  Description of Artificial Sequence: Synthetic oligonucleotide
guccaucaacgagugggcc

SEQ ID NO: 944 - RNA, 19 nt, Artificial Sequence
  Description of Artificial Sequence: Synthetic oligonucleotide
augacuucgugcgcagcag

SEQ ID NO: 945 - RNA, 19 nt, Artificial Sequence
  Description of Artificial Sequence: Synthetic oligonucleotide
ucccugcuauucauugggc

SEQ ID NO: 946 - RNA, 19 nt, Artificial Sequence
  Description of Artificial Sequence: Synthetic oligonucleotide
cugcgcgacgaggaggugc

SEQ ID NO: 947 - RNA, 19 nt, Artificial Sequence
  Description of Artificial Sequence: Synthetic oligonucleotide
caagcugcccgaggucacc

SEQ ID NO: 948 - RNA, 19 nt, Artificial Sequence
  Description of Artificial Sequence: Synthetic oligonucleotide
aagcugcccgaggucacca

SEQ ID NO: 949 - RNA, 19 nt, Artificial Sequence
  Description of Artificial Sequence: Synthetic oligonucleotide
uucuucaagccacacuggg

SEQ ID NO: 950 - RNA, 19 nt, Artificial Sequence
  Description of Artificial Sequence: Synthetic oligonucleotide
acaccuggcugggcugggc

SEQ ID NO: 951 - RNA, 19 nt, Artificial Sequence
  Description of Artificial Sequence: Synthetic oligonucleotide
uccaucaacgagugggccg

SEQ ID NO: 952 - RNA, 19 nt, Artificial Sequence
  Description of Artificial Sequence: Synthetic oligonucleotide
aucuacgggcgcgaggagc

SEQ ID NO: 953 - RNA, 19 nt, Artificial Sequence
  Description of Artificial Sequence: Synthetic oligonucleotide
ucgugcgcagcagcaagca

SEQ ID NO: 954 - RNA, 19 nt, Artificial Sequence
  Description of Artificial Sequence: Synthetic oligonucleotide
cgacggcaagcugcccgag

SEQ ID NO: 955 - RNA, 19 nt, Artificial Sequence
  Description of Artificial Sequence: Synthetic oligonucleotide
uucauugggcgccuggucc

SEQ ID NO: 956 - RNA, 19 nt, Artificial Sequence
  Description of Artificial Sequence: Synthetic oligonucleotide
uugaccaggacaucuacgg

SEQ ID NO: 957 - RNA, 19 nt, Artificial Sequence
  Description of Artificial Sequence: Synthetic oligonucleotide
ccuggcccacaagcucucc

SEQ ID NO: 958 - RNA, 19 nt, Artificial Sequence
  Description of Artificial Sequence: Synthetic oligonucleotide
ugacuucgugcgcagcagc

SEQ ID NO: 959 - RNA, 19 nt, Artificial Sequence
  Description of Artificial Sequence: Synthetic oligonucleotide
augaugcaccggacaggcc

SEQ ID NO: 960 - RNA, 19 nt, Artificial Sequence
  Description of Artificial Sequence: Synthetic oligonucleotide
caccgacggcaagcugccc

SEQ ID NO: 961 - RNA, 19 nt, Artificial Sequence
  Description of Artificial Sequence: Synthetic oligonucleotide
gacggcaagcugcccgagg

SEQ ID NO: 962 - RNA, 19 nt, Artificial Sequence
  Description of Artificial Sequence: Synthetic oligonucleotide
uaccaggccauggccaagg

SEQ ID NO: 963 - RNA, 19 nt, Artificial Sequence
  Description of Artificial Sequence: Synthetic oligonucleotide
uccgcgacaagcgcagcgc

SEQ ID NO: 964 - RNA, 19 nt, Artificial Sequence
  Description of Artificial Sequence: Synthetic oligonucleotide
uuccgcgacaagcgcagcg

SEQ ID NO: 965 - RNA, 19 nt, Artificial Sequence
  Description of Artificial Sequence: Synthetic oligonucleotide
aaggacguggagcgcacgg

SEQ ID NO: 966 - RNA, 19 nt, Artificial Sequence
  Description of Artificial Sequence: Synthetic oligonucleotide
uuccaccacaagauggugg

SEQ ID NO: 967 - RNA, 19 nt, Artificial Sequence
  Description of Artificial Sequence: Synthetic oligonucleotide
uacgggcgcgaggagcugc

SEQ ID NO: 968 - RNA, 19 nt, Artificial Sequence
  Description of Artificial Sequence: Synthetic oligonucleotide
aaacaccuggcugggcugg

SEQ ID NO: 969 - RNA, 19 nt, Artificial Sequence
  Description of Artificial Sequence: Synthetic oligonucleotide
aacaccuggcugggcuggg

SEQ ID NO: 970 - RNA, 19 nt, Artificial Sequence
  Description of Artificial Sequence: Synthetic oligonucleotide
auugggcgccugguccggc

SEQ ID NO: 971 - RNA, 19 nt, Artificial Sequence
  Description of Artificial Sequence: Synthetic oligonucleotide
accgacggcaagcugcccg

SEQ ID NO: 972 - RNA, 19 nt, Artificial Sequence
  Description of Artificial Sequence: Synthetic oligonucleotide
uucgugcgcagcagcaagc

SEQ ID NO: 973 - RNA, 19 nt, Artificial Sequence
  Description of Artificial Sequence: Synthetic oligonucleotide
agugcucgcaguuguagug

SEQ ID NO: 974 - RNA, 19 nt, Artificial Sequence
  Description of Artificial Sequence: Synthetic oligonucleotide
ucaccaugaagccacgguu

SEQ ID NO: 975 - RNA, 19 nt, Artificial Sequence
  Description of Artificial Sequence: Synthetic oligonucleotide
gguacagguccuucuugcc

SEQ ID NO: 976 - RNA, 19 nt, Artificial Sequence
  Description of Artificial Sequence: Synthetic oligonucleotide
gaagccacgguuguccacc

SEQ ID NO: 977 - RNA, 19 nt, Artificial Sequence
  Description of Artificial Sequence: Synthetic oligonucleotide
ugguccuuggccauggccu

SEQ ID NO: 978 - RNA, 19 nt, Artificial Sequence
  Description of Artificial Sequence: Synthetic oligonucleotide
uggacugcagcgcgcugcg

SEQ ID NO: 979 - RNA, 19 nt, Artificial Sequence
  Description of Artificial Sequence: Synthetic oligonucleotide
uguagugcugcuugcugcu

SEQ ID NO: 980 - RNA, 19 nt, Artificial Sequence
  Description of Artificial Sequence: Synthetic oligonucleotide
cguaguaguuguagaggcc

SEQ ID NO: 981 - RNA, 19 nt, Artificial Sequence
  Description of Artificial Sequence: Synthetic oligonucleotide
agccuucuucugcaucuuc

SEQ ID NO: 982 - RNA, 19 nt, Artificial Sequence
  Description of Artificial Sequence: Synthetic oligonucleotide
cccaugugucucaggagcc

SEQ ID NO: 983 - RNA, 19 nt, Artificial Sequence
  Description of Artificial Sequence: Synthetic oligonucleotide
aguuguagugcugcuugcu

SEQ ID NO: 984 - RNA, 19 nt, Artificial Sequence
  Description of Artificial Sequence: Synthetic oligonucleotide
caggucaugggucaccucc

SEQ ID NO: 985 - RNA, 19 nt, Artificial Sequence
  Description of Artificial Sequence: Synthetic oligonucleotide
agauguccuggucaaaggg

SEQ ID NO: 986 - RNA, 19 nt, Artificial Sequence
  Description of Artificial Sequence: Synthetic oligonucleotide
cacccaugugucucaggag

SEQ ID NO: 987 - RNA, 19 nt, Artificial Sequence
  Description of Artificial Sequence: Synthetic oligonucleotide
caugugucucaggagccuu

SEQ ID NO: 988 - RNA, 19 nt, Artificial Sequence
  Description of Artificial Sequence: Synthetic oligonucleotide
guugauggacugcagcgcg

SEQ ID NO: 989 - RNA, 19 nt, Artificial Sequence
  Description of Artificial Sequence: Synthetic oligonucleotide
gucaccuccaccacacccu

SEQ ID NO: 990 - RNA, 19 nt, Artificial Sequence
  Description of Artificial Sequence: Synthetic oligonucleotide
ugcucgcaguuguagugcu

SEQ ID NO: 991 - RNA, 19 nt, Artificial Sequence
  Description of Artificial Sequence: Synthetic oligonucleotide
caaugaauagcagggagcc

SEQ ID NO: 992 - RNA, 19 nt, Artificial Sequence
  Description of Artificial Sequence: Synthetic oligonucleotide
uccaggucacguugcgcgc

SEQ ID NO: 993 - RNA, 19 nt, Artificial Sequence
  Description of Artificial Sequence: Synthetic oligonucleotide
cucguugauggacugcagc

SEQ ID NO: 994 - RNA, 19 nt, Artificial Sequence
  Description of Artificial Sequence: Synthetic oligonucleotide
ucuucagcugcucuuuggu

SEQ ID NO: 995 - RNA, 19 nt, Artificial Sequence
  Description of Artificial Sequence: Synthetic oligonucleotide
gugcgcuccacguccuugg

SEQ ID NO: 996 - RNA, 19 nt, Artificial Sequence
  Description of Artificial Sequence: Synthetic oligonucleotide
caguguggcuugaagaaca

SEQ ID NO: 997 - RNA, 19 nt, Artificial Sequence
  Description of Artificial Sequence: Synthetic oligonucleotide
cuccaccacacccuugggc

SEQ ID NO: 998 - RNA, 19 nt, Artificial Sequence
  Description of Artificial Sequence: Synthetic oligonucleotide
aguaguuguagaggccugu

SEQ ID NO: 999 - RNA, 19 nt, Artificial Sequence
  Description of Artificial Sequence: Synthetic oligonucleotide
ugcugcuugcugcugcgca

SEQ ID NO: 1000 - RNA, 19 nt, Artificial Sequence
  Description of Artificial Sequence: Synthetic oligonucleotide
gucaugggucaccuccacc

SEQ ID NO: 1001 - RNA, 19 nt, Artificial Sequence
  Description of Artificial Sequence: Synthetic oligonucleotide
guagauguccuggucaaag

SEQ ID NO: 1002 - RNA, 19 nt, Artificial Sequence
  Description of Artificial Sequence: Synthetic oligonucleotide
ucaccuccaccacacccuu

SEQ ID NO: 1003 - RNA, 19 nt, Artificial Sequence
  Description of Artificial Sequence: Synthetic oligonucleotide
ugacacccacgguauagga

SEQ ID NO: 1004 - RNA, 19 nt, Artificial Sequence
  Description of Artificial Sequence: Synthetic oligonucleotide
ugccgucgguggucugcgc

SEQ ID NO: 1005 - RNA, 19 nt, Artificial Sequence
  Description of Artificial Sequence: Synthetic oligonucleotide
agugcugcuugcugcugcg

SEQ ID NO: 1006 - RNA, 19 nt, Artificial Sequence
  Description of Artificial Sequence: Synthetic oligonucleotide
ggcaugaggaugaugaggc

SEQ ID NO: 1007 - RNA, 19 nt, Artificial Sequence
  Description of Artificial Sequence: Synthetic oligonucleotide
aggaugaugaggcuggaga

SEQ ID NO: 1008 - RNA, 19 nt, Artificial Sequence
  Description of Artificial Sequence: Synthetic oligonucleotide
gccuuguucuugucaaugg

SEQ ID NO: 1009 - RNA, 19 nt, Artificial Sequence
  Description of Artificial Sequence: Synthetic oligonucleotide
ucgcaguuguagugcugcu

SEQ ID NO: 1010 - RNA, 19 nt, Artificial Sequence
  Description of Artificial Sequence: Synthetic oligonucleotide
uagaggccuguccggugca

SEQ ID NO: 1011 - RNA, 19 nt, Artificial Sequence
  Description of Artificial Sequence: Synthetic oligonucleotide
cggaaguugaucuuggagu

SEQ ID NO: 1012 - RNA, 19 nt, Artificial Sequence
  Description of Artificial Sequence: Synthetic oligonucleotide
augaagccacgguugucca

SEQ ID NO: 1013 - RNA, 19 nt, Artificial Sequence
  Description of Artificial Sequence: Synthetic oligonucleotide
uccagaucuucagcugcuc

SEQ ID NO: 1014 - RNA, 19 nt, Artificial Sequence
  Description of Artificial Sequence: Synthetic oligonucleotide
uggcaacagccuucuucug

SEQ ID NO: 1015 - RNA, 19 nt, Artificial Sequence
  Description of Artificial Sequence: Synthetic oligonucleotide
guacagguccuucuugccu

SEQ ID NO: 1016 - RNA, 19 nt, Artificial Sequence
  Description of Artificial Sequence: Synthetic oligonucleotide
gucguaguaguuguagagg

SEQ ID NO: 1017 - RNA, 19 nt, Artificial Sequence
  Description of Artificial Sequence: Synthetic oligonucleotide
auccagaucuucagcugcu

SEQ ID NO: 1018 - RNA, 19 nt, Artificial Sequence
  Description of Artificial Sequence: Synthetic oligonucleotide
ucucgucgucguaguaguu

SEQ ID NO: 1019 - RNA, 19 nt, Artificial Sequence
  Description of Artificial Sequence: Synthetic oligonucleotide
ugaccucgggcagcuugcc

SEQ ID NO: 1020 - RNA, 19 nt, Artificial Sequence
  Description of Artificial Sequence: Synthetic oligonucleotide
guuguagaggccuguccgg

SEQ ID NO: 1021 - RNA, 19 nt, Artificial Sequence
  Description of Artificial Sequence: Synthetic oligonucleotide
ccaaugaauagcagggagc

SEQ ID NO: 1022 - RNA, 19 nt, Artificial Sequence
  Description of Artificial Sequence: Synthetic oligonucleotide
ucuuggagugcucgcaguu

SEQ ID NO: 1023 - RNA, 19 nt, Artificial Sequence
  Description of Artificial Sequence: Synthetic oligonucleotide
ccaauagcacccauguguc

SEQ ID NO: 1024 - RNA, 19 nt, Artificial Sequence
  Description of Artificial Sequence: Synthetic oligonucleotide
guagaggccuguccggugc

SEQ ID NO: 1025 - RNA, 19 nt, Artificial Sequence
  Description of Artificial Sequence: Synthetic oligonucleotide
gacugcagcgcgcugcgcu

SEQ ID NO: 1026 - RNA, 19 nt, Artificial Sequence
  Description of Artificial Sequence: Synthetic oligonucleotide
guccgugcgcuccacgucc

SEQ ID NO: 1027 - RNA, 19 nt, Artificial Sequence
  Description of Artificial Sequence: Synthetic oligonucleotide
caugaggaugaugaggcug

SEQ ID NO: 1028 - RNA, 19 nt, Artificial Sequence
  Description of Artificial Sequence: Synthetic oligonucleotide
ugucgcggaaguugaucuu

SEQ ID NO: 1029 - RNA, 19 nt, Artificial Sequence
  Description of Artificial Sequence: Synthetic oligonucleotide
cuuccaggucacguugcgc

SEQ ID NO: 1030 - RNA, 19 nt, Artificial Sequence
  Description of Artificial Sequence: Synthetic oligonucleotide
aucuuggagugcucgcagu

SEQ ID NO: 1031 - RNA, 19 nt, Artificial Sequence
  Description of Artificial Sequence: Synthetic oligonucleotide
ugaagccacgguuguccac

SEQ ID NO: 1032 - RNA, 19 nt, Artificial Sequence
  Description of Artificial Sequence: Synthetic oligonucleotide
gaggcuggagagcuugugg

SEQ ID NO: 1033 - RNA, 19 nt, Artificial Sequence
  Description of Artificial Sequence: Synthetic oligonucleotide
acgguuguccaccaucuug

SEQ ID NO: 1034 - RNA, 19 nt, Artificial Sequence
  Description of Artificial Sequence: Synthetic oligonucleotide
guugaucuuggagugcucg

SEQ ID NO: 1035 - RNA, 19 nt, Artificial Sequence
  Description of Artificial Sequence: Synthetic oligonucleotide
uuggugaccucgggcagcu

SEQ ID NO: 1036 - RNA, 19 nt, Artificial Sequence
  Description of Artificial Sequence: Synthetic oligonucleotide
cucgcgcccguagaugucc

SEQ ID NO: 1037 - RNA, 19 nt, Artificial Sequence
  Description of Artificial Sequence: Synthetic oligonucleotide
ucgcgcccguagauguccu

SEQ ID NO: 1038 - RNA, 19 nt, Artificial Sequence
  Description of Artificial Sequence: Synthetic oligonucleotide
agguccuucuugccugaca

SEQ ID NO: 1039 - RNA, 19 nt, Artificial Sequence
  Description of Artificial Sequence: Synthetic oligonucleotide
ggucaccuccaccacaccc

SEQ ID NO: 1040 - RNA, 19 nt, Artificial Sequence
  Description of Artificial Sequence: Synthetic oligonucleotide
gaugaggcuggagagcuug

SEQ ID NO: 1041 - RNA, 19 nt, Artificial Sequence
  Description of Artificial Sequence: Synthetic oligonucleotide
ucugcaggucaugggucac

SEQ ID NO: 1042 - RNA, 19 nt, Artificial Sequence
  Description of Artificial Sequence: Synthetic oligonucleotide
ccaguguggcuugaagaac

SEQ ID NO: 1043 - RNA, 19 nt, Artificial Sequence
  Description of Artificial Sequence: Synthetic oligonucleotide
uccucgcgcccguagaugu

SEQ ID NO: 1044 - RNA, 19 nt, Artificial Sequence
  Description of Artificial Sequence: Synthetic oligonucleotide
aggucaugggucaccucca

SEQ ID NO: 1045 - RNA, 19 nt, Artificial Sequence
  Description of Artificial Sequence: Synthetic oligonucleotide
gcaacagccuucuucugca

SEQ ID NO: 1046 - RNA, 19 nt, Artificial Sequence
  Description of Artificial Sequence: Synthetic oligonucleotide
uuggccauggccugguaca

SEQ ID NO: 1047 - RNA, 19 nt, Artificial Sequence
  Description of Artificial Sequence: Synthetic oligonucleotide
augggucaccuccaccaca

SEQ ID NO: 1048 - RNA, 19 nt, Artificial Sequence
  Description of Artificial Sequence: Synthetic oligonucleotide
gccagguacagguccuucu

SEQ ID NO: 1049 - RNA, 19 nt, Artificial Sequence
  Description of Artificial Sequence: Synthetic oligonucleotide
uccucgucgcgcagcugcu

SEQ ID NO: 1050 - RNA, 19 nt, Artificial Sequence
  Description of Artificial Sequence: Synthetic oligonucleotide
ggcuugaagaacauggcgu

SEQ ID NO: 1051 - RNA, 19 nt, Artificial Sequence
  Description of Artificial Sequence: Synthetic oligonucleotide
cgguuguccaccaucuugu

SEQ ID NO: 1052 - RNA, 19 nt, Artificial Sequence
  Description of Artificial Sequence: Synthetic oligonucleotide
gaucuuggagugcucgcag

SEQ ID NO: 1053 - RNA, 19 nt, Artificial Sequence
  Description of Artificial Sequence: Synthetic oligonucleotide
cuugccugacaugcgugac

SEQ ID NO: 1054 - RNA, 19 nt, Artificial Sequence
  Description of Artificial Sequence: Synthetic oligonucleotide
cuucuugccugacaugcgu

SEQ ID NO: 1055 - RNA, 19 nt, Artificial Sequence
  Description of Artificial Sequence: Synthetic oligonucleotide
aggcgcccaaugaauagca

SEQ ID NO: 1056 - RNA, 19 nt, Artificial Sequence
  Description of Artificial Sequence: Synthetic oligonucleotide
ugcaccuccucgucgcgca

SEQ ID NO: 1057 - RNA, 19 nt, Artificial Sequence
  Description of Artificial Sequence: Synthetic oligonucleotide
cauccagaucuucagcugc

SEQ ID NO: 1058 - RNA, 19 nt, Artificial Sequence
  Description of Artificial Sequence: Synthetic oligonucleotide
guguuucugcaggucaugg

SEQ ID NO: 1059 - RNA, 19 nt, Artificial Sequence
  Description of Artificial Sequence: Synthetic oligonucleotide
ugaugaggcuggagagcuu

SEQ ID NO: 1060 - RNA, 19 nt, Artificial Sequence
  Description of Artificial Sequence: Synthetic oligonucleotide
guuguagugcugcuugcug

SEQ ID NO: 1061 - RNA, 19 nt, Artificial Sequence
  Description of Artificial Sequence: Synthetic oligonucleotide
aguguggcuugaagaacau

SEQ ID NO: 1062 - RNA, 19 nt, Artificial Sequence
  Description of Artificial Sequence: Synthetic oligonucleotide
gcacccaugugucucagga

SEQ ID NO: 1063 - RNA, 19 nt, Artificial Sequence
  Description of Artificial Sequence: Synthetic oligonucleotide
ggaaguugaucuuggagug

SEQ ID NO: 1064 - RNA, 19 nt, Artificial Sequence
  Description of Artificial Sequence: Synthetic oligonucleotide
cucgcaucuugucacccuu

SEQ ID NO: 1065 - RNA, 19 nt, Artificial Sequence
  Description of Artificial Sequence: Synthetic oligonucleotide
guaguuguagaggccuguc

SEQ ID NO: 1066 - RNA, 19 nt, Artificial Sequence
  Description of Artificial Sequence: Synthetic oligonucleotide
guuucugcaggucaugggu

SEQ ID NO: 1067 - RNA, 19 nt, Artificial Sequence
  Description of Artificial Sequence: Synthetic oligonucleotide
uguccaccaucuuguggug

SEQ ID NO: 1068 - RNA, 19 nt, Artificial Sequence
  Description of Artificial Sequence: Synthetic oligonucleotide
ggcaacagccuucuucugc

SEQ ID NO: 1069 - RNA, 19 nt, Artificial Sequence
  Description of Artificial Sequence: Synthetic oligonucleotide
caugggucaccuccaccac

SEQ ID NO: 1070 - RNA, 19 nt, Artificial Sequence
  Description of Artificial Sequence: Synthetic oligonucleotide
guaguaguuguagaggccu

SEQ ID NO: 1071 - RNA, 19 nt, Artificial Sequence
  Description of Artificial Sequence: Synthetic oligonucleotide
cugcaggucaugggucacc

SEQ ID NO: 1072 - RNA, 19 nt, Artificial Sequence
  Description of Artificial Sequence: Synthetic oligonucleotide
cagguuucuucaccucggc

SEQ ID NO: 1073 - RNA, 19 nt, Artificial Sequence
  Description of Artificial Sequence: Synthetic oligonucleotide
cucgucgucguaguaguug

SEQ ID NO: 1074 - RNA, 19 nt, Artificial Sequence
  Description of Artificial Sequence: Synthetic oligonucleotide
cagguacagguccuucuug

SEQ ID NO: 1075 - RNA, 19 nt, Artificial Sequence
  Description of Artificial Sequence: Synthetic oligonucleotide
aaggcgguggcguggaaca

SEQ ID NO: 1076 - RNA, 19 nt, Artificial Sequence
  Description of Artificial Sequence: Synthetic oligonucleotide
cgcccaaugaauagcaggg

SEQ ID NO: 1077 - RNA, 19 nt, Artificial Sequence
  Description of Artificial Sequence: Synthetic oligonucleotide
agucaccaugaagccacgg

SEQ ID NO: 1078 - RNA, 19 nt, Artificial Sequence
  Description of Artificial Sequence: Synthetic oligonucleotide
gucgucguaguaguuguag

SEQ ID NO: 1079 - RNA, 19 nt, Artificial Sequence
  Description of Artificial Sequence: Synthetic oligonucleotide
cucgcaguuguagugcugc

SEQ ID NO: 1080 - RNA, 19 nt, Artificial Sequence
  Description of Artificial Sequence: Synthetic oligonucleotide
aagccacgguuguccacca

SEQ ID NO: 1081 - RNA, 19 nt, Artificial Sequence
  Description of Artificial Sequence: Synthetic oligonucleotide
agcuugccgucgguggucu

SEQ ID NO: 1082 - RNA, 19 nt, Artificial Sequence
  Description of Artificial Sequence: Synthetic oligonucleotide
agcccagccagguguuucu

SEQ ID NO: 1083 - RNA, 19 nt, Artificial Sequence
  Description of Artificial Sequence: Synthetic oligonucleotide
ugcgcuccacguccuuggu

SEQ ID NO: 1084 - RNA, 19 nt, Artificial Sequence
  Description of Artificial Sequence: Synthetic oligonucleotide
gcagguuucuucaccucgg

SEQ ID NO: 1085 - RNA, 19 nt, Artificial Sequence
  Description of Artificial Sequence: Synthetic oligonucleotide
gagugcucgcaguuguagu

SEQ ID NO: 1086 - RNA, 19 nt, Artificial Sequence
  Description of Artificial Sequence: Synthetic oligonucleotide
augaggcuggagagcuugu

SEQ ID NO: 1087 - RNA, 19 nt, Artificial Sequence
  Description of Artificial Sequence: Synthetic oligonucleotide
uccgugcgcuccacguccu

SEQ ID NO: 1088 - RNA, 19 nt, Artificial Sequence
  Description of Artificial Sequence: Synthetic oligonucleotide
caggcgcccaaugaauagc

SEQ ID NO: 1089 - RNA, 19 nt, Artificial Sequence
  Description of Artificial Sequence: Synthetic oligonucleotide
ugcgcuugucgcggaaguu

SEQ ID NO: 1090 - RNA, 19 nt, Artificial Sequence
  Description of Artificial Sequence: Synthetic oligonucleotide
gaugaugaggcuggagagc

SEQ ID NO: 1091 - RNA, 19 nt, Artificial Sequence
  Description of Artificial Sequence: Synthetic oligonucleotide
gagauggcaacagccuucu

SEQ ID NO: 1092 - RNA, 19 nt, Artificial Sequence
  Description of Artificial Sequence: Synthetic oligonucleotide
cuccacguccuuggugacc

SEQ ID NO: 1093 - RNA, 19 nt, Artificial Sequence
  Description of Artificial Sequence: Synthetic oligonucleotide
accuccucgucgcgcagcu

SEQ ID NO: 1094 - RNA, 19 nt, Artificial Sequence
  Description of Artificial Sequence: Synthetic oligonucleotide
cguccuuggugaccucggg

SEQ ID NO: 1095 - RNA, 19 nt, Artificial Sequence
  Description of Artificial Sequence: Synthetic oligonucleotide
gguccuucuugccugacau

SEQ ID NO: 1096 - RNA, 19 nt, Artificial Sequence
  Description of Artificial Sequence: Synthetic oligonucleotide
cacguccuuggugaccucg

SEQ ID NO: 1097 - RNA, 19 nt, Artificial Sequence
  Description of Artificial Sequence: Synthetic oligonucleotide
gaggccuguccggugcauc

SEQ ID NO: 1098 - RNA, 19 nt, Artificial Sequence
  Description of Artificial Sequence: Synthetic oligonucleotide
gugcucgcaguuguagugc

SEQ ID NO: 1099 - RNA, 19 nt, Artificial Sequence
  Description of Artificial Sequence: Synthetic oligonucleotide
guuguccaccaucuugugg

SEQ ID NO: 1100 - RNA, 19 nt, Artificial Sequence
  Description of Artificial Sequence: Synthetic oligonucleotide
caccuccaccacacccuug

SEQ ID NO: 1101 - RNA, 19 nt, Artificial Sequence
  Description of Artificial Sequence: Synthetic oligonucleotide
cccauccagaucuucagcu

SEQ ID NO: 1102 - RNA, 19 nt, Artificial Sequence
  Description of Artificial Sequence: Synthetic oligonucleotide
uccuuggccauggccuggu

SEQ ID NO: 1103 - RNA, 19 nt, Artificial Sequence
  Description of Artificial Sequence: Synthetic oligonucleotide
guguggcuugaagaacaug

SEQ ID NO: 1104 - RNA, 19 nt, Artificial Sequence
  Description of Artificial Sequence: Synthetic oligonucleotide
gucgcggaaguugaucuug

SEQ ID NO: 1105 - RNA, 19 nt, Artificial Sequence
  Description of Artificial Sequence: Synthetic oligonucleotide
ugaggaugaugaggcugga

SEQ ID NO: 1106 - RNA, 19 nt, Artificial Sequence
  Description of Artificial Sequence: Synthetic oligonucleotide
guccuuggugaccucgggc

SEQ ID NO: 1107 - RNA, 19 nt, Artificial Sequence
  Description of Artificial Sequence: Synthetic oligonucleotide
ucaucccaguguggcuuga

SEQ ID NO: 1108 - RNA, 19 nt, Artificial Sequence
  Description of Artificial Sequence: Synthetic oligonucleotide
gcccacucguugauggacu

SEQ ID NO: 1109 - RNA, 19 nt, Artificial Sequence
  Description of Artificial Sequence: Synthetic oligonucleotide
ugcugcugcgcacgaaguc

SEQ ID NO: 1110 - RNA, 19 nt, Artificial Sequence
  Description of Artificial Sequence: Synthetic oligonucleotide
ggaugaugaggcuggagag

SEQ ID NO: 1111 - RNA, 19 nt, Artificial Sequence
  Description of Artificial Sequence: Synthetic oligonucleotide
cuugccgucgguggucugc

SEQ ID NO: 1112 - RNA, 19 nt, Artificial Sequence
  Description of Artificial Sequence: Synthetic oligonucleotide
caacagccuucuucugcau

SEQ ID NO: 1113 - RNA, 19 nt, Artificial Sequence
  Description of Artificial Sequence: Synthetic oligonucleotide
caccaugaagccacgguug

SEQ ID NO: 1114 - RNA, 19 nt, Artificial Sequence
  Description of Artificial Sequence: Synthetic oligonucleotide
ccuucucgucgucguagua

SEQ ID NO: 1115 - RNA, 19 nt, Artificial Sequence
  Description of Artificial Sequence: Synthetic oligonucleotide
ggagauggcaacagccuuc

SEQ ID NO: 1116 - RNA, 19 nt, Artificial Sequence
  Description of Artificial Sequence: Synthetic oligonucleotide
cgcuccacguccuugguga

SEQ ID NO: 1117 - RNA, 19 nt, Artificial Sequence
  Description of Artificial Sequence: Synthetic oligonucleotide
ccauccagaucuucagcug

SEQ ID NO: 1118 - RNA, 19 nt, Artificial Sequence
  Description of Artificial Sequence: Synthetic oligonucleotide
auggccucagucaggccca

SEQ ID NO: 1119 - RNA, 19 nt, Artificial Sequence
  Description of Artificial Sequence: Synthetic oligonucleotide
gucaccaugaagccacggu

SEQ ID NO: 1120 - RNA, 19 nt, Artificial Sequence
  Description of Artificial Sequence: Synthetic oligonucleotide
cccacucguugauggacug

SEQ ID NO: 1121 - RNA, 19 nt, Artificial Sequence
  Description of Artificial Sequence: Synthetic oligonucleotide
ucgggcagcuugccgucgg

SEQ ID NO: 1122 - RNA, 19 nt, Artificial Sequence
  Description of Artificial Sequence: Synthetic oligonucleotide
ugcagcgcgcugcgcuugu

SEQ ID NO: 1123 - RNA, 19 nt, Artificial Sequence
  Description of Artificial Sequence: Synthetic oligonucleotide
cagcccagccagguguuuc

SEQ ID NO: 1124 - RNA, 19 nt, Artificial Sequence
  Description of Artificial Sequence: Synthetic oligonucleotide
ccaugugucucaggagccu

SEQ ID NO: 1125 - RNA, 19 nt, Artificial Sequence
  Description of Artificial Sequence: Synthetic oligonucleotide
cgugcgcuccacguccuug

SEQ ID NO: 1126 - RNA, 19 nt, Artificial Sequence
  Description of Artificial Sequence: Synthetic oligonucleotide
ccacucguugauggacugc

SEQ ID NO: 1127 - RNA, 19 nt, Artificial Sequence
  Description of Artificial Sequence: Synthetic oligonucleotide
ccacgguuguccaccaucu

SEQ ID NO: 1128 - RNA, 19 nt, Artificial Sequence
  Description of Artificial Sequence: Synthetic oligonucleotide
acugcagcgcgcugcgcuu

SEQ ID NO: 1129 - RNA, 19 nt, Artificial Sequence
  Description of Artificial Sequence: Synthetic oligonucleotide
guccuucuugccugacaug

SEQ ID NO: 1130 - RNA, 19 nt, Artificial Sequence
  Description of Artificial Sequence: Synthetic oligonucleotide
cucaucccaguguggcuug

SEQ ID NO: 1131 - RNA, 19 nt, Artificial Sequence
  Description of Artificial Sequence: Synthetic oligonucleotide
cagccuucuucugcaucuu

SEQ ID NO: 1132 - RNA, 19 nt, Artificial Sequence
  Description of Artificial Sequence: Synthetic oligonucleotide
cugguccuuggccauggcc

SEQ ID NO: 1133 - RNA, 19 nt, Artificial Sequence
  Description of Artificial Sequence: Synthetic oligonucleotide
gcugcuugcugcugcgcac

SEQ ID NO: 1134 - RNA, 19 nt, Artificial Sequence
  Description of Artificial Sequence: Synthetic oligonucleotide
cuuggagugcucgcaguug

SEQ ID NO: 1135 - RNA, 19 nt, Artificial Sequence
  Description of Artificial Sequence: Synthetic oligonucleotide
uggagugcucgcaguugua

SEQ ID NO: 1136 - RNA, 19 nt, Artificial Sequence
  Description of Artificial Sequence: Synthetic oligonucleotide
ggccuuguucuugucaaug

SEQ ID NO: 1137 - RNA, 19 nt, Artificial Sequence
  Description of Artificial Sequence: Synthetic oligonucleotide
gcaguuguagugcugcuug

SEQ ID NO: 1138 - RNA, 19 nt, Artificial Sequence
  Description of Artificial Sequence: Synthetic oligonucleotide
aggcgguggcguggaacac

SEQ ID NO: 1139 - RNA, 19 nt, Artificial Sequence
  Description of Artificial Sequence: Synthetic oligonucleotide
gcgcccaaugaauagcagg

SEQ ID NO: 1140 - RNA, 19 nt, Artificial Sequence
  Description of Artificial Sequence: Synthetic oligonucleotide
ggcuggagagcuugugggc

SEQ ID NO: 1141 - RNA, 19 nt, Artificial Sequence
  Description of Artificial Sequence: Synthetic oligonucleotide
guagugcugcuugcugcug

SEQ ID NO: 1142 - RNA, 19 nt, Artificial Sequence
  Description of Artificial Sequence: Synthetic oligonucleotide
aggccuguccggugcauca

SEQ ID NO: 1143 - RNA, 19 nt, Artificial Sequence
  Description of Artificial Sequence: Synthetic oligonucleotide
cgcuugucgcggaaguuga

SEQ ID NO: 1144 - RNA, 19 nt, Artificial Sequence
  Description of Artificial Sequence: Synthetic oligonucleotide
acagguccuucuugccuga

SEQ ID NO: 1145 - RNA, 19 nt, Artificial Sequence
  Description of Artificial Sequence: Synthetic oligonucleotide
uugcugcugcgcacgaagu

SEQ ID NO: 1146 - RNA, 19 nt, Artificial Sequence
  Description of Artificial Sequence: Synthetic oligonucleotide
accaugaagccacgguugu

SEQ ID NO: 1147 - RNA, 19 nt, Artificial Sequence
  Description of Artificial Sequence: Synthetic oligonucleotide
aggagauggcaacagccuu

SEQ ID NO: 1148 - RNA, 19 nt, Artificial Sequence
  Description of Artificial Sequence: Synthetic oligonucleotide
cuccucgucgcgcagcugc

SEQ ID NO: 1149 - RNA, 19 nt, Artificial Sequence
  Description of Artificial Sequence: Synthetic oligonucleotide
accaggcgcccaaugaaua

SEQ ID NO: 1150 - RNA, 19 nt, Artificial Sequence
  Description of Artificial Sequence: Synthetic oligonucleotide
uccaccaucuuguggugga

SEQ ID NO: 1151 - RNA, 19 nt, Artificial Sequence
  Description of Artificial Sequence: Synthetic oligonucleotide
gagagcuugugggccaggg

SEQ ID NO: 1152 - RNA, 19 nt, Artificial Sequence
  Description of Artificial Sequence: Synthetic oligonucleotide
cgcccguagauguccuggu

SEQ ID NO: 1153 - RNA, 19 nt, Artificial Sequence
  Description of Artificial Sequence: Synthetic oligonucleotide
gccuguccggugcaucauc

SEQ ID NO: 1154 - RNA, 19 nt, Artificial Sequence
  Description of Artificial Sequence: Synthetic oligonucleotide
cuugaagaacauggcguug

SEQ ID NO: 1155 - RNA, 19 nt, Artificial Sequence
  Description of Artificial Sequence: Synthetic oligonucleotide
accucgggcagcuugccgu

SEQ ID NO: 1156 - RNA, 19 nt, Artificial Sequence
  Description of Artificial Sequence: Synthetic oligonucleotide
gauggacugcagcgcgcug

SEQ ID NO: 1157 - RNA, 19 nt, Artificial Sequence
  Description of Artificial Sequence: Synthetic oligonucleotide
ccuccaccacacccuuggg

SEQ ID NO: 1158 - RNA, 19 nt, Artificial Sequence
  Description of Artificial Sequence: Synthetic oligonucleotide
ugccugguccuuggccaug

SEQ ID NO: 1159 - RNA, 19 nt, Artificial Sequence
  Description of Artificial Sequence: Synthetic oligonucleotide
gaggaugaugaggcuggag

SEQ ID NO: 1160 - RNA, 19 nt, Artificial Sequence
  Description of Artificial Sequence: Synthetic oligonucleotide
agcuccucgcgcccguaga

SEQ ID NO: 1161 - RNA, 19 nt, Artificial Sequence
  Description of Artificial Sequence: Synthetic oligonucleotide
gcuggagagcuugugggcc

SEQ ID NO: 1162 - RNA, 19 nt, Artificial Sequence
  Description of Artificial Sequence: Synthetic oligonucleotide
cagguccuucuugccugac

SEQ ID NO: 1163 - RNA, 19 nt, Artificial Sequence
  Description of Artificial Sequence: Synthetic oligonucleotide
cuccucgcgcccguagaug

SEQ ID NO: 1164 - RNA, 19 nt, Artificial Sequence
  Description of Artificial Sequence: Synthetic oligonucleotide
cugcuugcugcugcgcacg

SEQ ID NO: 1165 - RNA, 19 nt, Artificial Sequence
  Description of Artificial Sequence: Synthetic oligonucleotide
gcaugaggaugaugaggcu

SEQ ID NO: 1166 - RNA, 19 nt, Artificial Sequence
  Description of Artificial Sequence: Synthetic oligonucleotide
caucccaguguggcuugaa

SEQ ID NO: 1167 - RNA, 19 nt, Artificial Sequence
  Description of Artificial Sequence: Synthetic oligonucleotide
agauggcaacagccuucuu

SEQ ID NO: 1168 - RNA, 19 nt, Artificial Sequence
  Description of Artificial Sequence: Synthetic oligonucleotide
gggucaccuccaccacacc

SEQ ID NO: 1169 - RNA, 19 nt, Artificial Sequence
  Description of Artificial Sequence: Synthetic oligonucleotide
gcaggucaugggucaccuc

SEQ ID NO: 1170 - RNA, 19 nt, Artificial Sequence
  Description of Artificial Sequence: Synthetic oligonucleotide
ggucaugggucaccuccac

SEQ ID NO: 1171 - RNA, 19 nt, Artificial Sequence
  Description of Artificial Sequence: Synthetic oligonucleotide
gguuguccaccaucuugug

SEQ ID NO: 1172 - RNA, 19 nt, Artificial Sequence
  Description of Artificial Sequence: Synthetic oligonucleotide
uggagagcuugugggccag

SEQ ID NO: 1173 - RNA, 19 nt, Artificial Sequence
  Description of Artificial Sequence: Synthetic oligonucleotide
ugcugcgcacgaagucauc

SEQ ID NO: 1174 - RNA, 19 nt, Artificial Sequence
  Description of Artificial Sequence: Synthetic oligonucleotide
cugcgcuugucgcggaagu

SEQ ID NO: 1175 - RNA, 19 nt, Artificial Sequence
  Description of Artificial Sequence: Synthetic oligonucleotide
gcuugaagaacauggcguu

SEQ ID NO: 1176 - RNA, 19 nt, Artificial Sequence
  Description of Artificial Sequence: Synthetic oligonucleotide
gcuggccagguacaggucc

SEQ ID NO: 1177 - RNA, 19 nt, Artificial Sequence
  Description of Artificial Sequence: Synthetic oligonucleotide
gcgugcaccuccucgucgc

SEQ ID NO: 1178 - RNA, 19 nt, Artificial Sequence
  Description of Artificial Sequence: Synthetic oligonucleotide
gugaccucgggcagcuugc

SEQ ID NO: 1179 - RNA, 19 nt, Artificial Sequence
  Description of Artificial Sequence: Synthetic oligonucleotide
gaccaggcgcccaaugaau

SEQ ID NO: 1180 - RNA, 19 nt, Artificial Sequence
  Description of Artificial Sequence: Synthetic oligonucleotide
ccacguccuuggugaccuc

SEQ ID NO: 1181 - RNA, 19 nt, Artificial Sequence
  Description of Artificial Sequence: Synthetic oligonucleotide
ccagguacagguccuucuu

SEQ ID NO: 1182 - RNA, 19 nt, Artificial Sequence
  Description of Artificial Sequence: Synthetic oligonucleotide
ccaugaagccacgguuguc

SEQ ID NO: 1183 - RNA, 19 nt, Artificial Sequence
  Description of Artificial Sequence: Synthetic oligonucleotide
uggccucagucaggcccag

SEQ ID NO: 1184 - RNA, 19 nt, Artificial Sequence
  Description of Artificial Sequence: Synthetic oligonucleotide
gcggaaguugaucuuggag

SEQ ID NO: 1185 - RNA, 19 nt, Artificial Sequence
  Description of Artificial Sequence: Synthetic oligonucleotide
gcgcuugucgcggaaguug

SEQ ID NO: 1186 - RNA, 19 nt, Artificial Sequence
  Description of Artificial Sequence: Synthetic oligonucleotide
cccaaugaauagcagggag

SEQ ID NO: 1187 - RNA, 19 nt, Artificial Sequence
  Description of Artificial Sequence: Synthetic oligonucleotide
cgcaguuguagugcugcuu

SEQ ID NO: 1188 - RNA, 19 nt, Artificial Sequence
  Description of Artificial Sequence: Synthetic oligonucleotide
gugcugcuugcugcugcgc

SEQ ID NO: 1189 - RNA, 19 nt, Artificial Sequence
  Description of Artificial Sequence: Synthetic oligonucleotide
gguccuuggccauggccug

SEQ ID NO: 1190 - RNA, 19 nt, Artificial Sequence
  Description of Artificial Sequence: Synthetic oligonucleotide
cuuggccauggccugguac

SEQ ID NO: 1191 - RNA, 19 nt, Artificial Sequence
  Description of Artificial Sequence: Synthetic oligonucleotide
cuugcugcugcgcacgaag

SEQ ID NO: 1192 - RNA, 19 nt, Artificial Sequence
  Description of Artificial Sequence: Synthetic oligonucleotide
gcucgcaguuguagugcug

SEQ ID NO: 1193 - RNA, 19 nt, Artificial Sequence
  Description of Artificial Sequence: Synthetic oligonucleotide
cgucgucguaguaguugua

SEQ ID NO: 1194 - RNA, 19 nt, Artificial Sequence
  Description of Artificial Sequence: Synthetic oligonucleotide
gccacgguuguccaccauc

SEQ ID NO: 1195 - RNA, 19 nt, Artificial Sequence
  Description of Artificial Sequence: Synthetic oligonucleotide
ggagugcucgcaguuguag

SEQ ID NO: 1196 - RNA, 19 nt, Artificial Sequence
  Description of Artificial Sequence: Synthetic oligonucleotide
uggccagguacagguccuu

SEQ ID NO: 1197 - RNA, 19 nt, Artificial Sequence
  Description of Artificial Sequence: Synthetic oligonucleotide
cuuggugaccucgggcagc

SEQ ID NO: 1198 - RNA, 19 nt, Artificial Sequence
  Description of Artificial Sequence: Synthetic oligonucleotide
ccucgcgcccguagauguc

SEQ ID NO: 1199 - RNA, 19 nt, Artificial Sequence
  Description of Artificial Sequence: Synthetic oligonucleotide
guccaccaucuuguggugg

SEQ ID NO: 1200 - RNA, 19 nt, Artificial Sequence
  Description of Artificial Sequence: Synthetic oligonucleotide
gugcaccuccucgucgcgc

SEQ ID NO: 1201 - RNA, 19 nt, Artificial Sequence
  Description of Artificial Sequence: Synthetic oligonucleotide
ccaggcgcccaaugaauag

SEQ ID NO: 1202 - RNA, 19 nt, Artificial Sequence
  Description of Artificial Sequence: Synthetic oligonucleotide
gcgcccguagauguccugg

SEQ ID NO: 1203 - RNA, 19 nt, Artificial Sequence
  Description of Artificial Sequence: Synthetic oligonucleotide
cacgguuguccaccaucuu

SEQ ID NO: 1204 - RNA, 19 nt, Artificial Sequence
  Description of Artificial Sequence: Synthetic oligonucleotide
cgcgcccguagauguccug

SEQ ID NO: 1205 - RNA, 19 nt, Artificial Sequence
  Description of Artificial Sequence: Synthetic oligonucleotide
cgcggaaguugaucuugga

SEQ ID NO: 1206 - RNA, 19 nt, Artificial Sequence
  Description of Artificial Sequence: Synthetic oligonucleotide
gcuccacguccuuggugac

SEQ ID NO: 1207 - RNA, 19 nt, Artificial Sequence
  Description of Artificial Sequence: Synthetic oligonucleotide
ccuuggugaccucgggcag

SEQ ID NO: 1208 - RNA, 19 nt, Artificial Sequence
  Description of Artificial Sequence: Synthetic oligonucleotide
gcccguagauguccugguc

SEQ ID NO: 1209 - RNA, 19 nt, Artificial Sequence
  Description of Artificial Sequence: Synthetic oligonucleotide
gccugguccuuggccaugg

SEQ ID NO: 1210 - RNA, 19 nt, Artificial Sequence
  Description of Artificial Sequence: Synthetic oligonucleotide
gcgcuccacguccuuggug

SEQ ID NO: 1211 - RNA, 19 nt, Artificial Sequence
  Description of Artificial Sequence: Synthetic oligonucleotide
gcagcgcgcugcgcuuguc

SEQ ID NO: 1212 - RNA, 19 nt, Artificial Sequence
  Description of Artificial Sequence: Synthetic oligonucleotide
cugcagcgcgcugcgcuug

SEQ ID NO: 1213 - RNA, 19 nt, Artificial Sequence
  Description of Artificial Sequence: Synthetic oligonucleotide
gcuugccgucgguggucug

SEQ ID NO: 1214 - RNA, 19 nt, Artificial Sequence
  Description of Artificial Sequence: Synthetic oligonucleotide
cagcuugccgucggugguc

SEQ ID NO: 1215 - RNA, 19 nt, Artificial Sequence
  Description of Artificial Sequence: Synthetic oligonucleotide
cuggccagguacagguccu

SEQ ID NO: 1216 - RNA, 19 nt, Artificial Sequence
  Description of Artificial Sequence: Synthetic oligonucleotide
ggcgcccaaugaauagcag

SEQ ID NO: 1217 - RNA, 19 nt, Artificial Sequence
  Description of Artificial Sequence: Synthetic oligonucleotide
cggaccaggcgcccaauga

SEQ ID NO: 1218 - RNA, 19 nt, Artificial Sequence
  Description of Artificial Sequence: Synthetic oligonucleotide
caccuccucgucgcgcagc

SEQ ID NO: 1219 - RNA, 19 nt, Artificial Sequence
  Description of Artificial Sequence: Synthetic oligonucleotide
gaccucgggcagcuugccg

SEQ ID NO: 1220 - RNA, 19 nt, Artificial Sequence
  Description of Artificial Sequence: Synthetic oligonucleotide
gggcaugaggaugaugagg

SEQ ID NO: 1221 - RNA, 19 nt, Artificial Sequence
  Description of Artificial Sequence: Synthetic oligonucleotide
guccuuggccauggccugg

SEQ ID NO: 1222 - RNA, 19 nt, Artificial Sequence
  Description of Artificial Sequence: Synthetic oligonucleotide
ccugguccuuggccauggc

SEQ ID NO: 1223 - RNA, 19 nt, Artificial Sequence
  Description of Artificial Sequence: Synthetic oligonucleotide
ggcagcuugccgucggugg

SEQ ID NO: 1224 - RNA, 19 nt, Artificial Sequence
  Description of Artificial Sequence: Synthetic oligonucleotide
agccacgguuguccaccau

SEQ ID NO: 1225 - RNA, 19 nt, Artificial Sequence
  Description of Artificial Sequence: Synthetic oligonucleotide
gcugcgcuugucgcggaag

SEQ ID NO: 1226 - RNA, 19 nt, Artificial Sequence
  Description of Artificial Sequence: Synthetic oligonucleotide
cgugcaccuccucgucgcg

SEQ ID NO: 1227 - RNA, 19 nt, Artificial Sequence
  Description of Artificial Sequence: Synthetic oligonucleotide
cuggagagcuugugggcca

SEQ ID NO: 1228 - RNA, 19 nt, Artificial Sequence
  Description of Artificial Sequence: Synthetic oligonucleotide
ccucgucgcgcagcugcuc

SEQ ID NO: 1229 - RNA, 19 nt, Artificial Sequence
  Description of Artificial Sequence: Synthetic oligonucleotide
cccguagauguccugguca

SEQ ID NO: 1230 - RNA, 19 nt, Artificial Sequence
  Description of Artificial Sequence: Synthetic oligonucleotide
gcagcuugccgucgguggu

SEQ ID NO: 1231 - RNA, 19 nt, Artificial Sequence
  Description of Artificial Sequence: Synthetic oligonucleotide
ggccagguacagguccuuc

SEQ ID NO: 1232 - RNA, 19 nt, Artificial Sequence
  Description of Artificial Sequence: Synthetic oligonucleotide
ccggaccaggcgcccaaug

SEQ ID NO: 1233 - RNA, 19 nt, Artificial Sequence
  Description of Artificial Sequence: Synthetic oligonucleotide
agaggccuguccggugcau

SEQ ID NO: 1234 - RNA, 19 nt, Artificial Sequence
  Description of Artificial Sequence: Synthetic oligonucleotide
gcuugucgcggaaguugau

SEQ ID NO: 1235 - RNA, 19 nt, Artificial Sequence
  Description of Artificial Sequence: Synthetic oligonucleotide
ccuccucgucgcgcagcug

SEQ ID NO: 1236 - RNA, 19 nt, Artificial Sequence
  Description of Artificial Sequence: Synthetic oligonucleotide
gcccagccagguguuucug

SEQ ID NO: 1237 - RNA, 19 nt, Artificial Sequence
  Description of Artificial Sequence: Synthetic oligonucleotide
cagcuccucgcgcccguag

SEQ ID NO: 1238 - RNA, 19 nt, Artificial Sequence
  Description of Artificial Sequence: Synthetic oligonucleotide
ggcgugcaccuccucgucg

SEQ ID NO: 1239 - RNA, 19 nt, Artificial Sequence
  Description of Artificial Sequence: Synthetic oligonucleotide
cguagauguccuggucaaa

SEQ ID NO: 1240 - RNA, 19 nt, Artificial Sequence
  Description of Artificial Sequence: Synthetic oligonucleotide
ggcccacucguugauggac

SEQ ID NO: 1241 - RNA, 19 nt, Artificial Sequence
  Description of Artificial Sequence: Synthetic oligonucleotide
cugcugcgcacgaagucau

SEQ ID NO: 1242 - RNA, 19 nt, Artificial Sequence
  Description of Artificial Sequence: Synthetic oligonucleotide
gcccaaugaauagcaggga

SEQ ID NO: 1243 - RNA, 19 nt, Artificial Sequence
  Description of Artificial Sequence: Synthetic oligonucleotide
gcaccuccucgucgcgcag

SEQ ID NO: 1244 - RNA, 19 nt, Artificial Sequence
  Description of Artificial Sequence: Synthetic oligonucleotide
ggugaccucgggcagcuug

SEQ ID NO: 1245 - RNA, 19 nt, Artificial Sequence
  Description of Artificial Sequence: Synthetic oligonucleotide
uggugaccucgggcagcuu

SEQ ID NO: 1246 - RNA, 19 nt, Artificial Sequence
  Description of Artificial Sequence: Synthetic oligonucleotide
cccaguguggcuugaagaa

SEQ ID NO: 1247 - RNA, 19 nt, Artificial Sequence
  Description of Artificial Sequence: Synthetic oligonucleotide
gcccagcccagccaggugu

SEQ ID NO: 1248 - RNA, 19 nt, Artificial Sequence
  Description of Artificial Sequence: Synthetic oligonucleotide
cggcccacucguugaugga

SEQ ID NO: 1249 - RNA, 19 nt, Artificial Sequence
  Description of Artificial Sequence: Synthetic oligonucleotide
gcuccucgcgcccguagau

SEQ ID NO: 1250 - RNA, 19 nt, Artificial Sequence
  Description of Artificial Sequence: Synthetic oligonucleotide
ugcuugcugcugcgcacga

SEQ ID NO: 1251 - RNA, 19 nt, Artificial Sequence
  Description of Artificial Sequence: Synthetic oligonucleotide
cucgggcagcuugccgucg

SEQ ID NO: 1252 - RNA, 19 nt, Artificial Sequence
  Description of Artificial Sequence: Synthetic oligonucleotide
ggaccaggcgcccaaugaa

SEQ ID NO: 1253 - RNA, 19 nt, Artificial Sequence
  Description of Artificial Sequence: Synthetic oligonucleotide
ccguagauguccuggucaa

SEQ ID NO: 1254 - RNA, 19 nt, Artificial Sequence
  Description of Artificial Sequence: Synthetic oligonucleotide
ggagagcuugugggccagg

SEQ ID NO: 1255 - RNA, 19 nt, Artificial Sequence
  Description of Artificial Sequence: Synthetic oligonucleotide
gcugcugcgcacgaaguca

SEQ ID NO: 1256 - RNA, 19 nt, Artificial Sequence
  Description of Artificial Sequence: Synthetic oligonucleotide
ggccuguccggugcaucau

SEQ ID NO: 1257 - RNA, 19 nt, Artificial Sequence
  Description of Artificial Sequence: Synthetic oligonucleotide
gggcagcuugccgucggug

SEQ ID NO: 1258 - RNA, 19 nt, Artificial Sequence
  Description of Artificial Sequence: Synthetic oligonucleotide
ccucgggcagcuugccguc

SEQ ID NO: 1259 - RNA, 19 nt, Artificial Sequence
  Description of Artificial Sequence: Synthetic oligonucleotide
ccuuggccauggccuggua

SEQ ID NO: 1260 - RNA, 19 nt, Artificial Sequence
  Description of Artificial Sequence: Synthetic oligonucleotide
gcgcugcgcuugucgcgga

SEQ ID NO: 1261 - RNA, 19 nt, Artificial Sequence
  Description of Artificial Sequence: Synthetic oligonucleotide
cgcugcgcuugucgcggaa

SEQ ID NO: 1262 - RNA, 19 nt, Artificial Sequence
  Description of Artificial Sequence: Synthetic oligonucleotide
ccgugcgcuccacguccuu

SEQ ID NO: 1263 - RNA, 19 nt, Artificial Sequence
  Description of Artificial Sequence: Synthetic oligonucleotide
ccaccaucuugugguggaa

SEQ ID NO: 1264 - RNA, 19 nt, Artificial Sequence
  Description of Artificial Sequence: Synthetic oligonucleotide
gcagcuccucgcgcccgua

SEQ ID NO: 1265 - RNA, 19 nt, Artificial Sequence
  Description of Artificial Sequence: Synthetic oligonucleotide
ccagcccagccagguguuu

SEQ ID NO: 1266 - RNA, 19 nt, Artificial Sequence
  Description of Artificial Sequence: Synthetic oligonucleotide
cccagcccagccagguguu

SEQ ID NO: 1267 - RNA, 19 nt, Artificial Sequence
  Description of Artificial Sequence: Synthetic oligonucleotide
gccggaccaggcgcccaau

SEQ ID NO: 1268 - RNA, 19 nt, Artificial Sequence
  Description of Artificial Sequence: Synthetic oligonucleotide
cgggcagcuugccgucggu

SEQ ID NO: 1269 - RNA, 19 nt, Artificial Sequence
  Description of Artificial Sequence: Synthetic oligonucleotide
gcuugcugcugcgcacgaa

SEQ ID NO: 1270 - RNA, 19 nt, Artificial Sequence
  Description of Artificial Sequence: Synthetic oligonucleotide
agccuuuguugcuaucaaa

SEQ ID NO: 1271 - RNA, 19 nt, Artificial Sequence
  Description of Artificial Sequence: Synthetic oligonucleotide
gccuaagggugacaagaua

SEQ ID NO: 1272 - RNA, 19 nt, Artificial Sequence
  Description of Artificial Sequence: Synthetic oligonucleotide
ggccuaagggugacaagaa

SEQ ID NO: 1273 - RNA, 19 nt, Artificial Sequence
  Description of Artificial Sequence: Synthetic oligonucleotide
ccucaaucaguauucauaa

SEQ ID NO: 1274 - RNA, 19 nt, Artificial Sequence
  Description of Artificial Sequence: Synthetic oligonucleotide
ggcggauugagaaggagca

SEQ ID NO: 1275 - RNA, 19 nt, Artificial Sequence
  Description of Artificial Sequence: Synthetic oligonucleotide
ggcaguggagaacauccua

SEQ ID NO: 1276 - RNA, 19 nt, Artificial Sequence
  Description of Artificial Sequence: Synthetic oligonucleotide
gggucagccagcccucuua

SEQ ID NO: 1277 - RNA, 19 nt, Artificial Sequence
  Description of Artificial Sequence: Synthetic oligonucleotide
gggugacaagaugcgagaa

SEQ ID NO: 1278 - RNA, 19 nt, Artificial Sequence
  Description of Artificial Sequence: Synthetic oligonucleotide
ggaccaggcaguggagaaa

SEQ ID NO: 1279 - RNA, 19 nt, Artificial Sequence
  Description of Artificial Sequence: Synthetic oligonucleotide
gagacacaugggugcuaua

SEQ ID NO: 1280 - RNA, 19 nt, Artificial Sequence
  Description of Artificial Sequence: Synthetic oligonucleotide
guuggagcguggaaaaaaa

SEQ ID NO: 1281 - RNA, 19 nt, Artificial Sequence
  Description of Artificial Sequence: Synthetic oligonucleotide
ggaacaugagccuuuguua

SEQ ID NO: 1282 - RNA, 19 nt, Artificial Sequence
  Description of Artificial Sequence: Synthetic oligonucleotide
gccauguucuucaagccaa

SEQ ID NO: 1283 - RNA, 19 nt, Artificial Sequence
  Description of Artificial Sequence: Synthetic oligonucleotide
ggauugagaaggagcucca

SEQ ID NO: 1284 - RNA, 19 nt, Artificial Sequence
  Description of Artificial Sequence: Synthetic oligonucleotide
gggaugaacuuuuuguuua

SEQ ID NO: 1285 - RNA, 19 nt, Artificial Sequence
  Description of Artificial Sequence: Synthetic oligonucleotide
gccgcagugaggcggauua

SEQ ID NO: 1286 - RNA, 19 nt, Artificial Sequence
  Description of Artificial Sequence: Synthetic oligonucleotide
ggaccuucccagcuagaaa

SEQ ID NO: 1287 - RNA, 19 nt, Artificial Sequence
  Description of Artificial Sequence: Synthetic oligonucleotide
gaccuucccagcuagaaua

SEQ ID NO: 1288 - RNA, 19 nt, Artificial Sequence
  Description of Artificial Sequence: Synthetic oligonucleotide
ccugugagaccaaauugaa

SEQ ID NO: 1289 - RNA, 19 nt, Artificial Sequence
  Description of Artificial Sequence: Synthetic oligonucleotide
uggagaacauccuggugua

SEQ ID NO: 1290 - RNA, 19 nt, Artificial Sequence
  Description of Artificial Sequence: Synthetic oligonucleotide
gccuuuguugcuaucaaua

SEQ ID NO: 1291 - RNA, 19 nt, Artificial Sequence
  Description of Artificial Sequence: Synthetic oligonucleotide
ccgccuuugaguuggacaa

SEQ ID NO: 1292 - RNA, 19 nt, Artificial Sequence
  Description of Artificial Sequence: Synthetic oligonucleotide
caggcaguggagaacauca

SEQ ID NO: 1293 - RNA, 19 nt, Artificial Sequence
  Description of Artificial Sequence: Synthetic oligonucleotide
caccugugagaccaaauua

SEQ ID NO: 1294 - RNA, 19 nt, Artificial Sequence
  Description of Artificial Sequence: Synthetic oligonucleotide
gggaagaugcagaagaaga

SEQ ID NO: 1295 - RNA, 19 nt, Artificial Sequence
  Description of Artificial Sequence: Synthetic oligonucleotide
ggccauugacaagaacaaa

SEQ ID NO: 1296 - RNA, 19 nt, Artificial Sequence
  Description of Artificial Sequence: Synthetic oligonucleotide
gccuuugaguuggacacaa

SEQ ID NO: 1297 - RNA, 19 nt, Artificial Sequence
  Description of Artificial Sequence: Synthetic oligonucleotide
agcggaccuucccagcuaa

SEQ ID NO: 1298 - RNA, 19 nt, Artificial Sequence
  Description of Artificial Sequence: Synthetic oligonucleotide
gaagaaggcuguugccaua

SEQ ID NO: 1299 - RNA, 19 nt, Artificial Sequence
  Description of Artificial Sequence: Synthetic oligonucleotide
acaagaugcgagacgagua

SEQ ID NO: 1300 - RNA, 19 nt, Artificial Sequence
  Description of Artificial Sequence: Synthetic oligonucleotide
gaggcggauugagaaggaa

SEQ ID NO: 1301 - RNA, 19 nt, Artificial Sequence
  Description of Artificial Sequence: Synthetic oligonucleotide
ggacaaccguggcuucaua

SEQ ID NO: 1302 - RNA, 19 nt, Artificial Sequence
  Description of Artificial Sequence: Synthetic oligonucleotide
cauauuuauagccagguaa

SEQ ID NO: 1303 - RNA, 19 nt, Artificial Sequence
  Description of Artificial Sequence: Synthetic oligonucleotide
cgacgacgagaaggaaaaa

SEQ ID NO: 1304 - RNA, 19 nt, Artificial Sequence
  Description of Artificial Sequence: Synthetic oligonucleotide
cucaccugugagaccaaaa

SEQ ID NO: 1305 - RNA, 19 nt, Artificial Sequence
  Description of Artificial Sequence: Synthetic oligonucleotide
gcggcucccugcuauucaa

SEQ ID NO: 1306 - RNA, 19 nt, Artificial Sequence
  Description of Artificial Sequence: Synthetic oligonucleotide
agaacauccuggugucaca

SEQ ID NO: 1307 - RNA, 19 nt, Artificial Sequence
  Description of Artificial Sequence: Synthetic oligonucleotide
cacacugggaugagaaaua

SEQ ID NO: 1308 - RNA, 19 nt, Artificial Sequence
  Description of Artificial Sequence: Synthetic oligonucleotide
gcuagaauucacuccacua

SEQ ID NO: 1309 - RNA, 19 nt, Artificial Sequence
  Description of Artificial Sequence: Synthetic oligonucleotide
ccuucaucuuccuagugca

SEQ ID NO: 1310 - RNA, 19 nt, Artificial Sequence
  Description of Artificial Sequence: Synthetic oligonucleotide
ugcuaucaauccaagaaca

SEQ ID NO: 1311 - RNA, 19 nt, Artificial Sequence
  Description of Artificial Sequence: Synthetic oligonucleotide
ggaagaugcagaagaagga

SEQ ID NO: 1312 - RNA, 19 nt, Artificial Sequence
  Description of Artificial Sequence: Synthetic oligonucleotide
caugagccuuuguugcuaa

SEQ ID NO: 1313 - RNA, 19 nt, Artificial Sequence
  Description of Artificial Sequence: Synthetic oligonucleotide
gcggauugagaaggagcua

SEQ ID NO: 1314 - RNA, 19 nt, Artificial Sequence
  Description of Artificial Sequence: Synthetic oligonucleotide
ugcaguccaucaacgagua

SEQ ID NO: 1315 - RNA, 19 nt, Artificial Sequence
  Description of Artificial Sequence: Synthetic oligonucleotide
gcacugcggagaaguugaa

SEQ ID NO: 1316 - RNA, 19 nt, Artificial Sequence
  Description of Artificial Sequence: Synthetic oligonucleotide
ccaggcaguggagaacaua

SEQ ID NO: 1317 - RNA, 19 nt, Artificial Sequence
  Description of Artificial Sequence: Synthetic oligonucleotide
ggcaagaaggaccuguaca

SEQ ID NO: 1318 - RNA, 19 nt, Artificial Sequence
  Description of Artificial Sequence: Synthetic oligonucleotide
cucuacaacuacuacgaca

SEQ ID NO: 1319 - RNA, 19 nt, Artificial Sequence
  Description of Artificial Sequence: Synthetic oligonucleotide
cuucccagcuagaauucaa

SEQ ID NO: 1320 - RNA, 19 nt, Artificial Sequence
  Description of Artificial Sequence: Synthetic oligonucleotide
aggcggauugagaaggaga

SEQ ID NO: 1321 - RNA, 19 nt, Artificial Sequence
  Description of Artificial Sequence: Synthetic oligonucleotide
gguccuauaccguggguga

SEQ ID NO: 1322 - RNA, 19 nt, Artificial Sequence
  Description of Artificial Sequence: Synthetic oligonucleotide
gcaagaaggaccuguacca

SEQ ID NO: 1323 - RNA, 19 nt, Artificial Sequence
  Description of Artificial Sequence: Synthetic oligonucleotide
ccgugggugucaugaugaa

SEQ ID NO: 1324 - RNA, 19 nt, Artificial Sequence
  Description of Artificial Sequence: Synthetic oligonucleotide
gaugcgagacgaguuauaa

SEQ ID NO: 1325 - RNA, 19 nt, Artificial Sequence
  Description of Artificial Sequence: Synthetic oligonucleotide
ggcagugcugagcgccgaa

SEQ ID NO: 1326 - RNA, 19 nt, Artificial Sequence
  Description of Artificial Sequence: Synthetic oligonucleotide
cagcuagaauucacuccaa

SEQ ID NO: 1327 - RNA, 19 nt, Artificial Sequence
  Description of Artificial Sequence: Synthetic oligonucleotide
gagcuucgcugaugacuua

SEQ ID NO: 1328 - RNA, 19 nt, Artificial Sequence
  Description of Artificial Sequence: Synthetic oligonucleotide
cuuugaguuggacacagaa

SEQ ID NO: 1329 - RNA, 19 nt, Artificial Sequence
  Description of Artificial Sequence: Synthetic oligonucleotide
gguggacaaccguggcuua

SEQ ID NO: 1330 - RNA, 19 nt, Artificial Sequence
  Description of Artificial Sequence: Synthetic oligonucleotide
gccucaucauccucaugca

SEQ ID NO: 1331 - RNA, 19 nt, Artificial Sequence
  Description of Artificial Sequence: Synthetic oligonucleotide
accaggcaguggagaacaa

SEQ ID NO: 1332 - RNA, 19 nt, Artificial Sequence
  Description of Artificial Sequence: Synthetic oligonucleotide
ccugccucaaucaguauua

SEQ ID NO: 1333 - RNA, 19 nt, Artificial Sequence
  Description of Artificial Sequence: Synthetic oligonucleotide
gaucaagccugccucaaua

SEQ ID NO: 1334 - RNA, 19 nt, Artificial Sequence
  Description of Artificial Sequence: Synthetic oligonucleotide
cagacucuggucaagaaga

SEQ ID NO: 1335 - RNA, 19 nt, Artificial Sequence
  Description of Artificial Sequence: Synthetic oligonucleotide
cgcgcugcaguccaucaaa

SEQ ID NO: 1336 - RNA, 19 nt, Artificial Sequence
  Description of Artificial Sequence: Synthetic oligonucleotide
cuggcacugcggagaagua

SEQ ID NO: 1337 - RNA, 19 nt, Artificial Sequence
  Description of Artificial Sequence: Synthetic oligonucleotide
ccagcucuaucccaaccua

SEQ ID NO: 1338 - RNA, 19 nt, Artificial Sequence
  Description of Artificial Sequence: Synthetic oligonucleotide
agggugugguggaggugaa

SEQ ID NO: 1339 - RNA, 19 nt, Artificial Sequence
  Description of Artificial Sequence: Synthetic oligonucleotide
agugaggcggauugagaaa

SEQ ID NO: 1340 - RNA, 19 nt, Artificial Sequence
  Description of Artificial Sequence: Synthetic oligonucleotide
cggacaggccucuacaaca

SEQ ID NO: 1341 - RNA, 19 nt, Artificial Sequence
  Description of Artificial Sequence: Synthetic oligonucleotide
cgacgagaaggaaaagcua

SEQ ID NO: 1342 - RNA, 19 nt, Artificial Sequence
  Description of Artificial Sequence: Synthetic oligonucleotide
aggccaaggcagugcugaa

SEQ ID NO: 1343 - RNA, 19 nt, Artificial Sequence
  Description of Artificial Sequence: Synthetic oligonucleotide
gccucagggugcacacaga

SEQ ID NO: 1344 - RNA, 19 nt, Artificial Sequence
  Description of Artificial Sequence: Synthetic oligonucleotide
ggaugagaaauuccaccaa

SEQ ID NO: 1345 - RNA, 19 nt, Artificial Sequence
  Description of Artificial Sequence: Synthetic oligonucleotide
agaaggaaaagcugcaaaa

SEQ ID NO: 1346 - RNA, 19 nt, Artificial Sequence
  Description of Artificial Sequence: Synthetic oligonucleotide
agcucuaucccaaccucua

SEQ ID NO: 1347 - RNA, 19 nt, Artificial Sequence
  Description of Artificial Sequence: Synthetic oligonucleotide
ugacaagaugcgagacgaa

SEQ ID NO: 1348 - RNA, 19 nt, Artificial Sequence
  Description of Artificial Sequence: Synthetic oligonucleotide
agaaggagcucccaggaga

SEQ ID NO: 1349 - RNA, 19 nt, Artificial Sequence
  Description of Artificial Sequence: Synthetic oligonucleotide
ccuucucaccugugagaca

SEQ ID NO: 1350 - RNA, 19 nt, Artificial Sequence
  Description of Artificial Sequence: Synthetic oligonucleotide
ggcuucugggcagacucua

SEQ ID NO: 1351 - RNA, 19 nt, Artificial Sequence
  Description of Artificial Sequence: Synthetic oligonucleotide
ccagccucaucauccucaa

SEQ ID NO: 1352 - RNA, 19 nt, Artificial Sequence
  Description of Artificial Sequence: Synthetic oligonucleotide
ccaaaggcuccugagacaa

SEQ ID NO: 1353 - RNA, 19 nt, Artificial Sequence
  Description of Artificial Sequence: Synthetic oligonucleotide
ggaccugggccauagucaa

SEQ ID NO: 1354 - RNA, 19 nt, Artificial Sequence
  Description of Artificial Sequence: Synthetic oligonucleotide
gggugucaugaugaugcaa

SEQ ID NO: 1355 - RNA, 19 nt, Artificial Sequence
  Description of Artificial Sequence: Synthetic oligonucleotide
guaccagccuuggauacua

SEQ ID NO: 1356 - RNA, 19 nt, Artificial Sequence
  Description of Artificial Sequence: Synthetic oligonucleotide
ggcuguugccaucuccuua

SEQ ID NO: 1357 - RNA, 19 nt, Artificial Sequence
  Description of Artificial Sequence: Synthetic oligonucleotide
cgcagugaggcggauugaa

SEQ ID NO: 1358 - RNA, 19 nt, Artificial Sequence
  Description of Artificial Sequence: Synthetic oligonucleotide
ccaaggacguggagcgcaa

SEQ ID NO: 1359 - RNA, 19 nt, Artificial Sequence
  Description of Artificial Sequence: Synthetic oligonucleotide
ggcuccugagacacaugga

SEQ ID NO: 1360 - RNA, 19 nt, Artificial Sequence
  Description of Artificial Sequence: Synthetic oligonucleotide
gcugcaguccaucaacgaa

SEQ ID NO: 1361 - RNA, 19 nt, Artificial Sequence
  Description of Artificial Sequence: Synthetic oligonucleotide
ccagguaccuucucaccua

SEQ ID NO: 1362 - RNA, 19 nt, Artificial Sequence
  Description of Artificial Sequence: Synthetic oligonucleotide
gcagcgcgcugcaguccaa

SEQ ID NO: 1363 - RNA, 19 nt, Artificial Sequence
  Description of Artificial Sequence: Synthetic oligonucleotide
gagaccaaauugagcuaga

SEQ ID NO: 1364 - RNA, 19 nt, Artificial Sequence
  Description of Artificial Sequence: Synthetic oligonucleotide
gccgccgaggugaagaaaa

SEQ ID NO: 1365 - RNA, 19 nt, Artificial Sequence
  Description of Artificial Sequence: Synthetic oligonucleotide
gcagacucuggucaagaaa

SEQ ID NO: 1366 - RNA, 19 nt, Artificial Sequence
  Description of Artificial Sequence: Synthetic oligonucleotide
cuagaauucacuccacuua

SEQ ID NO: 1367 - RNA, 19 nt, Artificial Sequence
  Description of Artificial Sequence: Synthetic oligonucleotide
gcaguggagaacauccuga

SEQ ID NO: 1368 - RNA, 19 nt, Artificial Sequence
  Description of Artificial Sequence: Synthetic oligonucleotide
cgcaugucaggcaagaaga

SEQ ID NO: 1369 - RNA, 19 nt, Artificial Sequence
  Description of Artificial Sequence: Synthetic oligonucleotide
cggauugagaaggagcuca

SEQ ID NO: 1370 - RNA, 19 nt, Artificial Sequence
  Description of Artificial Sequence: Synthetic oligonucleotide
aggugagguaccagccuua

SEQ ID NO: 1371 - RNA, 19 nt, Artificial Sequence
  Description of Artificial Sequence: Synthetic oligonucleotide
ccacacugggaugagaaaa

SEQ ID NO: 1372 - RNA, 19 nt, Artificial Sequence
  Description of Artificial Sequence: Synthetic oligonucleotide
gccauugacaagaacaaga

SEQ ID NO: 1373 - RNA, 19 nt, Artificial Sequence
  Description of Artificial Sequence: Synthetic oligonucleotide
gcgcugcaguccaucaaca

SEQ ID NO: 1374 - RNA, 19 nt, Artificial Sequence
  Description of Artificial Sequence: Synthetic oligonucleotide
cucccaacuauaaaacuaa

SEQ ID NO: 1375 - RNA, 19 nt, Artificial Sequence
  Description of Artificial Sequence: Synthetic oligonucleotide
ggugacaagaugcgagaca

SEQ ID NO: 1376 - RNA, 19 nt, Artificial Sequence
  Description of Artificial Sequence: Synthetic oligonucleotide
ggccgacuugucacgcaua

SEQ ID NO: 1377 - RNA, 19 nt, Artificial Sequence
  Description of Artificial Sequence: Synthetic oligonucleotide
ccuaagggugacaagauga

SEQ ID NO: 1378 - RNA, 19 nt, Artificial Sequence
  Description of Artificial Sequence: Synthetic oligonucleotide
ugagacacaugggugcuaa

SEQ ID NO: 1379 - RNA, 19 nt, Artificial Sequence
  Description of Artificial Sequence: Synthetic oligonucleotide
ggguggaaaaacagaccga

SEQ ID NO: 1380 - RNA, 19 nt, Artificial Sequence
  Description of Artificial Sequence: Synthetic oligonucleotide
gguggaggugacccaugaa

SEQ ID NO: 1381 - RNA, 19 nt, Artificial Sequence
  Description of Artificial Sequence: Synthetic oligonucleotide
cuuugaccaggacaucuaa

SEQ ID NO: 1382 - RNA, 19 nt, Artificial Sequence
  Description of Artificial Sequence: Synthetic oligonucleotide
gaacaugagccuuuguuga

SEQ ID NO: 1383 - RNA, 19 nt, Artificial Sequence
  Description of Artificial Sequence: Synthetic oligonucleotide
agccuuggauacuccauga

SEQ ID NO: 1384 - RNA, 19 nt, Artificial Sequence
  Description of Artificial Sequence: Synthetic oligonucleotide
ggaggugacccaugaccua

SEQ ID NO: 1385 - RNA, 19 nt, Artificial Sequence
  Description of Artificial Sequence: Synthetic oligonucleotide
agaucaagccugccucaaa

SEQ ID NO: 1386 - RNA, 19 nt, Artificial Sequence
  Description of Artificial Sequence: Synthetic oligonucleotide
gcccaagggugugguggaa

SEQ ID NO: 1387 - RNA, 19 nt, Artificial Sequence
  Description of Artificial Sequence: Synthetic oligonucleotide
agaacaaggccgacuugua

SEQ ID NO: 1388 - RNA, 19 nt, Artificial Sequence
  Description of Artificial Sequence: Synthetic oligonucleotide
guggcuucauggugacuca

SEQ ID NO: 1389 - RNA, 19 nt, Artificial Sequence
  Description of Artificial Sequence: Synthetic oligonucleotide
cuccugagacacaugggua

SEQ ID NO: 1390 - RNA, 19 nt, Artificial Sequence
  Description of Artificial Sequence: Synthetic oligonucleotide
cagccuuggauacuccaua

SEQ ID NO: 1391 - RNA, 19 nt, Artificial Sequence
  Description of Artificial Sequence: Synthetic oligonucleotide
aaggcuccugagacacaua

SEQ ID NO: 1392 - RNA, 19 nt, Artificial Sequence
  Description of Artificial Sequence: Synthetic oligonucleotide
agaagaaggcuguugccaa

SEQ ID NO: 1393 - RNA, 19 nt, Artificial Sequence
  Description of Artificial Sequence: Synthetic oligonucleotide
cuacuacgacgacgagaaa

SEQ ID NO: 1394 - RNA, 19 nt, Artificial Sequence
  Description of Artificial Sequence: Synthetic oligonucleotide
ccuuuguugcuaucaauca

SEQ ID NO: 1395 - RNA, 19 nt, Artificial Sequence
  Description of Artificial Sequence: Synthetic oligonucleotide
aggcaguggagaacaucca

SEQ ID NO: 1396 - RNA, 19 nt, Artificial Sequence
  Description of Artificial Sequence: Synthetic oligonucleotide
ccaucacguggagccucua

SEQ ID NO: 1397 - RNA, 19 nt, Artificial Sequence
  Description of Artificial Sequence: Synthetic oligonucleotide
agcucuccagccucaucaa

SEQ ID NO: 1398 - RNA, 19 nt, Artificial Sequence
  Description of Artificial Sequence: Synthetic oligonucleotide
ggcucccugcuauucauua

SEQ ID NO: 1399 - RNA, 19 nt, Artificial Sequence
  Description of Artificial Sequence: Synthetic oligonucleotide
gggaacaugagccuuugua

SEQ ID NO: 1400 - RNA, 19 nt, Artificial Sequence
  Description of Artificial Sequence: Synthetic oligonucleotide
gggccauagucauucugca

SEQ ID NO: 1401 - RNA, 19 nt, Artificial Sequence
  Description of Artificial Sequence: Synthetic oligonucleotide
ccaaagagcagcugaagaa

SEQ ID NO: 1402 - RNA, 19 nt, Artificial Sequence
  Description of Artificial Sequence: Synthetic oligonucleotide
gacgagaaggaaaagcuga

SEQ ID NO: 1403 - RNA, 19 nt, Artificial Sequence
  Description of Artificial Sequence: Synthetic oligonucleotide
gggcuucugggcagacuca

SEQ ID NO: 1404 - RNA, 19 nt, Artificial Sequence
  Description of Artificial Sequence: Synthetic oligonucleotide
caaggaccaggcaguggaa

SEQ ID NO: 1405 - RNA, 19 nt, Artificial Sequence
  Description of Artificial Sequence: Synthetic oligonucleotide
cugugagaccaaauugaga

SEQ ID NO: 1406 - RNA, 19 nt, Artificial Sequence
  Description of Artificial Sequence: Synthetic oligonucleotide
gacugaggccauugacaaa

SEQ ID NO: 1407 - RNA, 19 nt, Artificial Sequence
  Description of Artificial Sequence: Synthetic oligonucleotide
gacuugucacgcaugucaa

SEQ ID NO: 1408 - RNA, 19 nt, Artificial Sequence
  Description of Artificial Sequence: Synthetic oligonucleotide
gaggugagguaccagccua

SEQ ID NO: 1409 - RNA, 19 nt, Artificial Sequence
  Description of Artificial Sequence: Synthetic oligonucleotide
cagauaccaugaugcugaa

SEQ ID NO: 1410 - RNA, 19 nt, Artificial Sequence
  Description of Artificial Sequence: Synthetic oligonucleotide
aggcaagaaggaccuguaa

SEQ ID NO: 1411 - RNA, 19 nt, Artificial Sequence
  Description of Artificial Sequence: Synthetic oligonucleotide
cugggaugagaaauuccaa

SEQ ID NO: 1412 - RNA, 19 nt, Artificial Sequence
  Description of Artificial Sequence: Synthetic oligonucleotide
agguaccagccuuggauaa

SEQ ID NO: 1413 - RNA, 19 nt, Artificial Sequence
  Description of Artificial Sequence: Synthetic oligonucleotide
cagccagcccucuucugaa

SEQ ID NO: 1414 - RNA, 19 nt, Artificial Sequence
  Description of Artificial Sequence: Synthetic oligonucleotide
gugucaugaugaugcacca

SEQ ID NO: 1415 - RNA, 19 nt, Artificial Sequence
  Description of Artificial Sequence: Synthetic oligonucleotide
ccucuacaacuacuacgaa

SEQ ID NO: 1416 - RNA, 19 nt, Artificial Sequence
  Description of Artificial Sequence: Synthetic oligonucleotide
ccgccgaggugaagaaaca

SEQ ID NO: 1417 - RNA, 19 nt, Artificial Sequence
  Description of Artificial Sequence: Synthetic oligonucleotide
gcuaucaauccaagaacua

SEQ ID NO: 1418 - RNA, 19 nt, Artificial Sequence
  Description of Artificial Sequence: Synthetic oligonucleotide
agccugccucaaucaguaa

SEQ ID NO: 1419 - RNA, 19 nt, Artificial Sequence
  Description of Artificial Sequence: Synthetic oligonucleotide
gguccggccuaagggugaa

SEQ ID NO: 1420 - RNA, 19 nt, Artificial Sequence
  Description of Artificial Sequence: Synthetic oligonucleotide
gaaggaaaagcugcaaaua

SEQ ID NO: 1421 - RNA, 19 nt, Artificial Sequence
  Description of Artificial Sequence: Synthetic oligonucleotide
ggccucuacaacuacuaca

SEQ ID NO: 1422 - RNA, 19 nt, Artificial Sequence
  Description of Artificial Sequence: Synthetic oligonucleotide
uguucuucaagccacacua

SEQ ID NO: 1423 - RNA, 19 nt, Artificial Sequence
  Description of Artificial Sequence: Synthetic oligonucleotide
ggccaaggcagugcugaga

SEQ ID NO: 1424 - RNA, 19 nt, Artificial Sequence
  Description of Artificial Sequence: Synthetic oligonucleotide
agaaauuccaccacaagaa

SEQ ID NO: 1425 - RNA, 19 nt, Artificial Sequence
  Description of Artificial Sequence: Synthetic oligonucleotide
cugcaguccaucaacgaga

SEQ ID NO: 1426 - RNA, 19 nt, Artificial Sequence
  Description of Artificial Sequence: Synthetic oligonucleotide
ccagcguguuccacgccaa

SEQ ID NO: 1427 - RNA, 19 nt, Artificial Sequence
  Description of Artificial Sequence: Synthetic oligonucleotide
gcucccuccugcuucucaa

SEQ ID NO: 1428 - RNA, 19 nt, Artificial Sequence
  Description of Artificial Sequence: Synthetic oligonucleotide
ccggacaggccucuacaaa

SEQ ID NO: 1429 - RNA, 19 nt, Artificial Sequence
  Description of Artificial Sequence: Synthetic oligonucleotide
cccaucacguggagccuca

SEQ ID NO: 1430 - RNA, 19 nt, Artificial Sequence
  Description of Artificial Sequence: Synthetic oligonucleotide
ccggccuaagggugacaaa

SEQ ID NO: 1431 - RNA, 19 nt, Artificial Sequence
  Description of Artificial Sequence: Synthetic oligonucleotide
ccuauaccgugggugucaa

SEQ ID NO: 1432 - RNA, 19 nt, Artificial Sequence
  Description of Artificial Sequence: Synthetic oligonucleotide
caguggagaacauccugga

SEQ ID NO: 1433 - RNA, 19 nt, Artificial Sequence
  Description of Artificial Sequence: Synthetic oligonucleotide
cacugggaugagaaauuca

SEQ ID NO: 1434 - RNA, 19 nt, Artificial Sequence
  Description of Artificial Sequence: Synthetic oligonucleotide
auccaaaggcuccugagaa

SEQ ID NO: 1435 - RNA, 19 nt, Artificial Sequence
  Description of Artificial Sequence: Synthetic oligonucleotide
ugagaaauuccaccacaaa

SEQ ID NO: 1436 - RNA, 19 nt, Artificial Sequence
  Description of Artificial Sequence: Synthetic oligonucleotide
gguggaaaaacagaccgga

SEQ ID NO: 1437 - RNA, 19 nt, Artificial Sequence
  Description of Artificial Sequence: Synthetic oligonucleotide
gcugggcagccgacuguaa

SEQ ID NO: 1438 - RNA, 19 nt, Artificial Sequence
  Description of Artificial Sequence: Synthetic oligonucleotide
ccauagucauucugccuga

SEQ ID NO: 1439 - RNA, 19 nt, Artificial Sequence
  Description of Artificial Sequence: Synthetic oligonucleotide
gcaccggacaggccucuaa

SEQ ID NO: 1440 - RNA, 19 nt, Artificial Sequence
  Description of Artificial Sequence: Synthetic oligonucleotide
guuggacacagauggcaaa

SEQ ID NO: 1441 - RNA, 19 nt, Artificial Sequence
  Description of Artificial Sequence: Synthetic oligonucleotide
gccugccucaaucaguaua

SEQ ID NO: 1442 - RNA, 19 nt, Artificial Sequence
  Description of Artificial Sequence: Synthetic oligonucleotide
gaucaacuuccgcgacaaa

SEQ ID NO: 1443 - RNA, 19 nt, Artificial Sequence
  Description of Artificial Sequence: Synthetic oligonucleotide
ggccgcagugaggcggaua

SEQ ID NO: 1444 - RNA, 19 nt, Artificial Sequence
  Description of Artificial Sequence: Synthetic oligonucleotide
cugcggagaaguugagcca

SEQ ID NO: 1445 - RNA, 19 nt, Artificial Sequence
  Description of Artificial Sequence: Synthetic oligonucleotide
gcauccaaaggcuccugaa

SEQ ID NO: 1446 - RNA, 19 nt, Artificial Sequence
  Description of Artificial Sequence: Synthetic oligonucleotide
gcuucugggcagacucuga

SEQ ID NO: 1447 - RNA, 19 nt, Artificial Sequence
  Description of Artificial Sequence: Synthetic oligonucleotide
ccagcccucuucugacaca

SEQ ID NO: 1448 - RNA, 19 nt, Artificial Sequence
  Description of Artificial Sequence: Synthetic oligonucleotide
gcucuaucccaaccucuca

SEQ ID NO: 1449 - RNA, 19 nt, Artificial Sequence
  Description of Artificial Sequence: Synthetic oligonucleotide
ggacguggagcgcacggaa

SEQ ID NO: 1450 - RNA, 19 nt, Artificial Sequence
  Description of Artificial Sequence: Synthetic oligonucleotide
ccaaggcagugcugagcga

SEQ ID NO: 1451 - RNA, 19 nt, Artificial Sequence
  Description of Artificial Sequence: Synthetic oligonucleotide
gcagaagaaggcuguugca

SEQ ID NO: 1452 - RNA, 19 nt, Artificial Sequence
  Description of Artificial Sequence: Synthetic oligonucleotide
gacauuuuguuggagcgua

SEQ ID NO: 1453 - RNA, 19 nt, Artificial Sequence
  Description of Artificial Sequence: Synthetic oligonucleotide
cgagcacuccaagaucaaa

SEQ ID NO: 1454 - RNA, 19 nt, Artificial Sequence
  Description of Artificial Sequence: Synthetic oligonucleotide
ucaugaugaugcaccggaa

SEQ ID NO: 1455 - RNA, 19 nt, Artificial Sequence
  Description of Artificial Sequence: Synthetic oligonucleotide
ccugcuucucagcgccuua

SEQ ID NO: 1456 - RNA, 19 nt, Artificial Sequence
  Description of Artificial Sequence: Synthetic oligonucleotide
cccaaccucucccaacuaa

SEQ ID NO: 1457 - RNA, 19 nt, Artificial Sequence
  Description of Artificial Sequence: Synthetic oligonucleotide
ugggcagacucuggucaaa

SEQ ID NO: 1458 - RNA, 19 nt, Artificial Sequence
  Description of Artificial Sequence: Synthetic oligonucleotide
cucuggucaagaagcauca

SEQ ID NO: 1459 - RNA, 19 nt, Artificial Sequence
  Description of Artificial Sequence: Synthetic oligonucleotide
gagccucucgagcgccuua

SEQ ID NO: 1460 - RNA, 19 nt, Artificial Sequence
  Description of Artificial Sequence: Synthetic oligonucleotide
agaaggcuguugccaucua

SEQ ID NO: 1461 - RNA, 19 nt, Artificial Sequence
  Description of Artificial Sequence: Synthetic oligonucleotide
cccugcuagucaacgccaa

SEQ ID NO: 1462 - RNA, 19 nt, Artificial Sequence
  Description of Artificial Sequence: Synthetic oligonucleotide
gccuucagcuuguaccaga

SEQ ID NO: 1463 - RNA, 19 nt, Artificial Sequence
  Description of Artificial Sequence: Synthetic oligonucleotide
gcugcuaaccaaagagcaa

SEQ ID NO: 1464 - RNA, 19 nt, Artificial Sequence
  Description of Artificial Sequence: Synthetic oligonucleotide
cccacaagcucuccagcca

SEQ ID NO: 1465 - RNA, 19 nt, Artificial Sequence
  Description of Artificial Sequence: Synthetic oligonucleotide
gcucccugcuauucauuga

SEQ ID NO: 1466 - RNA, 19 nt, Artificial Sequence
  Description of Artificial Sequence: Synthetic oligonucleotide
guucuucaaagauagggaa

SEQ ID NO: 1467 - RNA, 19 nt, Artificial Sequence
  Description of Artificial Sequence: Synthetic oligonucleotide
gucagccagcccucuucua

SEQ ID NO: 1468 - RNA, 19 nt, Artificial Sequence
  Description of Artificial Sequence: Synthetic oligonucleotide
gcgggacacccaaagcgga

SEQ ID NO: 1469 - RNA, 19 nt, Artificial Sequence
  Description of Artificial Sequence: Synthetic oligonucleotide
agcgcagcgcgcugcagua

SEQ ID NO: 1470 - RNA, 19 nt, Artificial Sequence
  Description of Artificial Sequence: Synthetic oligonucleotide
ccggaaacuccacauccua

SEQ ID NO: 1471 - RNA, 19 nt, Artificial Sequence
  Description of Artificial Sequence: Synthetic oligonucleotide
ccauugacaagaacaagga

SEQ ID NO: 1472 - RNA, 19 nt, Artificial Sequence
  Description of Artificial Sequence: Synthetic oligonucleotide
ggacaucuacgggcgcgaa

SEQ ID NO: 1473 - RNA, 19 nt, Artificial Sequence
  Description of Artificial Sequence: Synthetic oligonucleotide
gacacaugggugcuauuga

SEQ ID NO: 1474 - RNA, 19 nt, Artificial Sequence
  Description of Artificial Sequence: Synthetic oligonucleotide
ccuggcacugcggagaaga

SEQ ID NO: 1475 - RNA, 19 nt, Artificial Sequence
  Description of Artificial Sequence: Synthetic oligonucleotide
gggccugacugaggccaua

SEQ ID NO: 1476 - RNA, 19 nt, Artificial Sequence
  Description of Artificial Sequence: Synthetic oligonucleotide
acacugggaugagaaauua

SEQ ID NO: 1477 - RNA, 19 nt, Artificial Sequence
  Description of Artificial Sequence: Synthetic oligonucleotide
ggucagccagcccucuuca

SEQ ID NO: 1478 - RNA, 19 nt, Artificial Sequence
  Description of Artificial Sequence: Synthetic oligonucleotide
gugaggcggauugagaaga

SEQ ID NO: 1479 - RNA, 19 nt, Artificial Sequence
  Description of Artificial Sequence: Synthetic oligonucleotide
ucaccugugagaccaaaua

SEQ ID NO: 1480 - RNA, 19 nt, Artificial Sequence
  Description of Artificial Sequence: Synthetic oligonucleotide
agcugcaaaucguggagaa

SEQ ID NO: 1481 - RNA, 19 nt, Artificial Sequence
  Description of Artificial Sequence: Synthetic oligonucleotide
ggugcacacaggauggcaa

SEQ ID NO: 1482 - RNA, 19 nt, Artificial Sequence
  Description of Artificial Sequence: Synthetic oligonucleotide
gggugugguggaggugaca

SEQ ID NO: 1483 - RNA, 19 nt, Artificial Sequence
  Description of Artificial Sequence: Synthetic oligonucleotide
ccagccuuggauacuccaa

SEQ ID NO: 1484 - RNA, 19 nt, Artificial Sequence
  Description of Artificial Sequence: Synthetic oligonucleotide
ccacaagcucuccagccua

SEQ ID NO: 1485 - RNA, 19 nt, Artificial Sequence
  Description of Artificial Sequence: Synthetic oligonucleotide
aaaggcuccugagacacaa

SEQ ID NO: 1486 - RNA, 19 nt, Artificial Sequence
  Description of Artificial Sequence: Synthetic oligonucleotide
aggaaaagcugcaaaucga

SEQ ID NO: 1487 - RNA, 19 nt, Artificial Sequence
  Description of Artificial Sequence: Synthetic oligonucleotide
cgcagcagcuccuggcaca

SEQ ID NO: 1488 - RNA, 19 nt, Artificial Sequence
  Description of Artificial Sequence: Synthetic oligonucleotide
ggugucaugaugaugcaca

SEQ ID NO: 1489 - RNA, 19 nt, Artificial Sequence
  Description of Artificial Sequence: Synthetic oligonucleotide
ccucuucugacacuaaaaa

SEQ ID NO: 1490 - RNA, 19 nt, Artificial Sequence
  Description of Artificial Sequence: Synthetic oligonucleotide
agcuagaauucacuccaca

SEQ ID NO: 1491 - RNA, 19 nt, Artificial Sequence
  Description of Artificial Sequence: Synthetic oligonucleotide
cgcugggcggcaaggcgaa

SEQ ID NO: 1492 - RNA, 19 nt, Artificial Sequence
  Description of Artificial Sequence: Synthetic oligonucleotide
ggccuggccuucagcuuga

SEQ ID NO: 1493 - RNA, 19 nt, Artificial Sequence
  Description of Artificial Sequence: Synthetic oligonucleotide
agacacaugggugcuauua

SEQ ID NO: 1494 - RNA, 19 nt, Artificial Sequence
  Description of Artificial Sequence: Synthetic oligonucleotide
cgugggugucaugaugaua

SEQ ID NO: 1495 - RNA, 19 nt, Artificial Sequence
  Description of Artificial Sequence: Synthetic oligonucleotide
gugggugucaugaugauga

SEQ ID NO: 1496 - RNA, 19 nt, Artificial Sequence
  Description of Artificial Sequence: Synthetic oligonucleotide
gagaaggagcucccaggaa

SEQ ID NO: 1497 - RNA, 19 nt, Artificial Sequence
  Description of Artificial Sequence: Synthetic oligonucleotide
gacucuggucaagaagcaa

SEQ ID NO: 1498 - RNA, 19 nt, Artificial Sequence
  Description of Artificial Sequence: Synthetic oligonucleotide
cacuaaaacaccucagcua

SEQ ID NO: 1499 - RNA, 19 nt, Artificial Sequence
  Description of Artificial Sequence: Synthetic oligonucleotide
ggaggcauccaaaggcuca

SEQ ID NO: 1500 - RNA, 19 nt, Artificial Sequence
  Description of Artificial Sequence: Synthetic oligonucleotide
gacccagcucagugagcua

SEQ ID NO: 1501 - RNA, 19 nt, Artificial Sequence
  Description of Artificial Sequence: Synthetic oligonucleotide
ccaugaccugcagaaacaa

SEQ ID NO: 1502 - RNA, 19 nt, Artificial Sequence
  Description of Artificial Sequence: Synthetic oligonucleotide
agaugcagaagaaggcuga

SEQ ID NO: 1503 - RNA, 19 nt, Artificial Sequence
  Description of Artificial Sequence: Synthetic oligonucleotide
cagcaagcagcacuacaaa

SEQ ID NO: 1504 - RNA, 19 nt, Artificial Sequence
  Description of Artificial Sequence: Synthetic oligonucleotide
caagcucuccagccucaua

SEQ ID NO: 1505 - RNA, 19 nt, Artificial Sequence
  Description of Artificial Sequence: Synthetic oligonucleotide
ugcagaagaaggcuguuga

SEQ ID NO: 1506 - RNA, 19 nt, Artificial Sequence
  Description of Artificial Sequence: Synthetic oligonucleotide
ggcgcgaggagcugcgcaa

SEQ ID NO: 1507 - RNA, 19 nt, Artificial Sequence
  Description of Artificial Sequence: Synthetic oligonucleotide
gguaccagccuuggauaca

SEQ ID NO: 1508 - RNA, 19 nt, Artificial Sequence
  Description of Artificial Sequence: Synthetic oligonucleotide
gcagccgacuguacggaca

SEQ ID NO: 1509 - RNA, 19 nt, Artificial Sequence
  Description of Artificial Sequence: Synthetic oligonucleotide
cagccucaucauccucaua

SEQ ID NO: 1510 - RNA, 19 nt, Artificial Sequence
  Description of Artificial Sequence: Synthetic oligonucleotide
gccaccgccuuugaguuga

SEQ ID NO: 1511 - RNA, 19 nt, Artificial Sequence
  Description of Artificial Sequence: Synthetic oligonucleotide
agaaggaccuguaccugga

SEQ ID NO: 1512 - RNA, 19 nt, Artificial Sequence
  Description of Artificial Sequence: Synthetic oligonucleotide
ggugaagaaaccugcagca

SEQ ID NO: 1513 - RNA, 19 nt, Artificial Sequence
  Description of Artificial Sequence: Synthetic oligonucleotide
guaccuucucaccugugaa

SEQ ID NO: 1514 - RNA, 19 nt, Artificial Sequence
  Description of Artificial Sequence: Synthetic oligonucleotide
ggccaaggaccaggcagua

SEQ ID NO: 1515 - RNA, 19 nt, Artificial Sequence
  Description of Artificial Sequence: Synthetic oligonucleotide
ggcggcaaggcgaccacga

SEQ ID NO: 1516 - RNA, 19 nt, Artificial Sequence
  Description of Artificial Sequence: Synthetic oligonucleotide
agcacuccaagaucaacua

SEQ ID NO: 1517 - RNA, 19 nt, Artificial Sequence
  Description of Artificial Sequence: Synthetic oligonucleotide
auauuuauagccagguaca

SEQ ID NO: 1518 - RNA, 19 nt, Artificial Sequence
  Description of Artificial Sequence: Synthetic oligonucleotide
ggcagccgacuguacggaa

SEQ ID NO: 1519 - RNA, 19 nt, Artificial Sequence
  Description of Artificial Sequence: Synthetic oligonucleotide
gucacgcaugucaggcaaa

SEQ ID NO: 1520 - RNA, 19 nt, Artificial Sequence
  Description of Artificial Sequence: Synthetic oligonucleotide
gacaggccucuacaacuaa

SEQ ID NO: 1521 - RNA, 19 nt, Artificial Sequence
  Description of Artificial Sequence: Synthetic oligonucleotide
gaugcagaagaaggcugua

SEQ ID NO: 1522 - RNA, 19 nt, Artificial Sequence
  Description of Artificial Sequence: Synthetic oligonucleotide
acccaugaccugcagaaaa

SEQ ID NO: 1523 - RNA, 19 nt, Artificial Sequence
  Description of Artificial Sequence: Synthetic oligonucleotide
ggcuucauggugacucgga

SEQ ID NO: 1524 - RNA, 19 nt, Artificial Sequence
  Description of Artificial Sequence: Synthetic oligonucleotide
ugccucaaucaguauucaa

SEQ ID NO: 1525 - RNA, 19 nt, Artificial Sequence
  Description of Artificial Sequence: Synthetic oligonucleotide
guucuucaagccacacuga

SEQ ID NO: 1526 - RNA, 19 nt, Artificial Sequence
  Description of Artificial Sequence: Synthetic oligonucleotide
acuccaagaucaacuucca

SEQ ID NO: 1527 - RNA, 19 nt, Artificial Sequence
  Description of Artificial Sequence: Synthetic oligonucleotide
gcuguucuacgccgaccaa

SEQ ID NO: 1528 - RNA, 19 nt, Artificial Sequence
  Description of Artificial Sequence: Synthetic oligonucleotide
uagucaacgccauguucua

SEQ ID NO: 1529 - RNA, 19 nt, Artificial Sequence
  Description of Artificial Sequence: Synthetic oligonucleotide
ccgugugccugagcggaca

SEQ ID NO: 1530 - RNA, 19 nt, Artificial Sequence
  Description of Artificial Sequence: Synthetic oligonucleotide
aggccucuacaacuacuaa

SEQ ID NO: 1531 - RNA, 19 nt, Artificial Sequence
  Description of Artificial Sequence: Synthetic oligonucleotide
gcuucauggugacucggua

SEQ ID NO: 1532 - RNA, 19 nt, Artificial Sequence
  Description of Artificial Sequence: Synthetic oligonucleotide
ggucaagaagcaucgugua

SEQ ID NO: 1533 - RNA, 19 nt, Artificial Sequence
  Description of Artificial Sequence: Synthetic oligonucleotide
cugcgagcacuccaagaua

SEQ ID NO: 1534 - RNA, 19 nt, Artificial Sequence
  Description of Artificial Sequence: Synthetic oligonucleotide
guccuauaccgugggugua

SEQ ID NO: 1535 - RNA, 19 nt, Artificial Sequence
  Description of Artificial Sequence: Synthetic oligonucleotide
ggccugacugaggccauua

SEQ ID NO: 1536 - RNA, 19 nt, Artificial Sequence
  Description of Artificial Sequence: Synthetic oligonucleotide
cacuccaagaucaacuuca

SEQ ID NO: 1537 - RNA, 19 nt, Artificial Sequence
  Description of Artificial Sequence: Synthetic oligonucleotide
gcgucgcaggccaaggcaa

SEQ ID NO: 1538 - RNA, 19 nt, Artificial Sequence
  Description of Artificial Sequence: Synthetic oligonucleotide
aagggugacaagaugcgaa

SEQ ID NO: 1539 - RNA, 19 nt, Artificial Sequence
  Description of Artificial Sequence: Synthetic oligonucleotide
caagcuguucuacgccgaa

SEQ ID NO: 1540 - RNA, 19 nt, Artificial Sequence
  Description of Artificial Sequence: Synthetic oligonucleotide
ccugcuagucaacgccaua

SEQ ID NO: 1541 - RNA, 19 nt, Artificial Sequence
  Description of Artificial Sequence: Synthetic oligonucleotide
ccaagggugugguggagga

SEQ ID NO: 1542 - RNA, 19 nt, Artificial Sequence
  Description of Artificial Sequence: Synthetic oligonucleotide
cacacaggauggcaggaga

SEQ ID NO: 1543 - RNA, 19 nt, Artificial Sequence
  Description of Artificial Sequence: Synthetic oligonucleotide
uccugagacacauggguga

SEQ ID NO: 1544 - RNA, 19 nt, Artificial Sequence
  Description of Artificial Sequence: Synthetic oligonucleotide
cuacaacuacuacgacgaa

SEQ ID NO: 1545 - RNA, 19 nt, Artificial Sequence
  Description of Artificial Sequence: Synthetic oligonucleotide
gacaagaugcgagacgaga

SEQ ID NO: 1546 - RNA, 19 nt, Artificial Sequence
  Description of Artificial Sequence: Synthetic oligonucleotide
ccuggaagcugggcagcca

SEQ ID NO: 1547 - RNA, 19 nt, Artificial Sequence
  Description of Artificial Sequence: Synthetic oligonucleotide
cuucaagccacacugggaa

SEQ ID NO: 1548 - RNA, 19 nt, Artificial Sequence
  Description of Artificial Sequence: Synthetic oligonucleotide
gcgagacgaguuauaggga

SEQ ID NO: 1549 - RNA, 19 nt, Artificial Sequence
  Description of Artificial Sequence: Synthetic oligonucleotide
gaagcugggcagccgacua

SEQ ID NO: 1550 - RNA, 19 nt, Artificial Sequence
  Description of Artificial Sequence: Synthetic oligonucleotide
gugccugagcggaccuuca

SEQ ID NO: 1551 - RNA, 19 nt, Artificial Sequence
  Description of Artificial Sequence: Synthetic oligonucleotide
ggugacccaugaccugcaa

SEQ ID NO: 1552 - RNA, 19 nt, Artificial Sequence
  Description of Artificial Sequence: Synthetic oligonucleotide
augagccuuuguugcuaua

SEQ ID NO: 1553 - RNA, 19 nt, Artificial Sequence
  Description of Artificial Sequence: Synthetic oligonucleotide
caacuacuacgacgacgaa

SEQ ID NO: 1554 - RNA, 19 nt, Artificial Sequence
  Description of Artificial Sequence: Synthetic oligonucleotide
gcugcgcucacucagcaaa

SEQ ID NO: 1555 - RNA, 19 nt, Artificial Sequence
  Description of Artificial Sequence: Synthetic oligonucleotide
gagaacauccuggugucaa

SEQ ID NO: 1556 - RNA, 19 nt, Artificial Sequence
  Description of Artificial Sequence: Synthetic oligonucleotide
cccaagcuguucuacgcca

SEQ ID NO: 1557 - RNA, 19 nt, Artificial Sequence
  Description of Artificial Sequence: Synthetic oligonucleotide
cagcucuaucccaaccuca

SEQ ID NO: 1558 - RNA, 19 nt, Artificial Sequence
  Description of Artificial Sequence: Synthetic oligonucleotide
ugagcuucgcugaugacua

SEQ ID NO: 1559 - RNA, 19 nt, Artificial Sequence
  Description of Artificial Sequence: Synthetic oligonucleotide
cccaaggcggccacgcuua

SEQ ID NO: 1560 - RNA, 19 nt, Artificial Sequence
  Description of Artificial Sequence: Synthetic oligonucleotide
cuauaccgugggugucaua

SEQ ID NO: 1561 - RNA, 19 nt, Artificial Sequence
  Description of Artificial Sequence: Synthetic oligonucleotide
cauugacaagaacaaggca

SEQ ID NO: 1562 - RNA, 19 nt, Artificial Sequence
  Description of Artificial Sequence: Synthetic oligonucleotide
ggacccagcucagugagca

SEQ ID NO: 1563 - RNA, 19 nt, Artificial Sequence
  Description of Artificial Sequence: Synthetic oligonucleotide
gacgacgagaaggaaaaga

SEQ ID NO: 1564 - RNA, 19 nt, Artificial Sequence
  Description of Artificial Sequence: Synthetic oligonucleotide
gcggcaaggcgaccacgga

SEQ ID NO: 1565 - RNA, 19 nt, Artificial Sequence
  Description of Artificial Sequence: Synthetic oligonucleotide
gggacacccaaagcggcua

SEQ ID NO: 1566 - RNA, 19 nt, Artificial Sequence
  Description of Artificial Sequence: Synthetic oligonucleotide
gggaggugagguaccagca

SEQ ID NO: 1567 - RNA, 19 nt, Artificial Sequence
  Description of Artificial Sequence: Synthetic oligonucleotide
gcagcacuacaacugcgaa

SEQ ID NO: 1568 - RNA, 19 nt, Artificial Sequence
  Description of Artificial Sequence: Synthetic oligonucleotide
gcgcaacgugaccuggaaa

SEQ ID NO: 1569 - RNA, 19 nt, Artificial Sequence
  Description of Artificial Sequence: Synthetic oligonucleotide
gggcugggccugacugaga

SEQ ID NO: 1570 - RNA, 19 nt, Artificial Sequence
  Description of Artificial Sequence: Synthetic oligonucleotide
ccugagcggaccuucccaa

SEQ ID NO: 1571 - RNA, 19 nt, Artificial Sequence
  Description of Artificial Sequence: Synthetic oligonucleotide
gcagcugaagaucuggaua

SEQ ID NO: 1572 - RNA, 19 nt, Artificial Sequence
  Description of Artificial Sequence: Synthetic oligonucleotide
aguggagaacauccuggua

SEQ ID NO: 1573 - RNA, 19 nt, Artificial Sequence
  Description of Artificial Sequence: Synthetic oligonucleotide
gcaagcagcacuacaacua

SEQ ID NO: 1574 - RNA, 19 nt, Artificial Sequence
  Description of Artificial Sequence: Synthetic oligonucleotide
agcucagugagcuucgcua

SEQ ID NO: 1575 - RNA, 19 nt, Artificial Sequence
  Description of Artificial Sequence: Synthetic oligonucleotide
ccgacuugucacgcaugua

SEQ ID NO: 1576 - RNA, 19 nt, Artificial Sequence
  Description of Artificial Sequence: Synthetic oligonucleotide
ccgaggucaccaaggacga

SEQ ID NO: 1577 - RNA, 19 nt, Artificial Sequence
  Description of Artificial Sequence: Synthetic oligonucleotide
ggagccucucgagcgccua

SEQ ID NO: 1578 - RNA, 19 nt, Artificial Sequence
  Description of Artificial Sequence: Synthetic oligonucleotide
ggccgcgcagaccaccgaa

SEQ ID NO: 1579 - RNA, 19 nt, Artificial Sequence
  Description of Artificial Sequence: Synthetic oligonucleotide
ggaaacuccacauccugua

SEQ ID NO: 1580 - RNA, 19 nt, Artificial Sequence
  Description of Artificial Sequence: Synthetic oligonucleotide
caaagcggcucccugcuaa

SEQ ID NO: 1581 - RNA, 19 nt, Artificial Sequence
  Description of Artificial Sequence: Synthetic oligonucleotide
gcuccugagacacauggga

SEQ ID NO: 1582 - RNA, 19 nt, Artificial Sequence
  Description of Artificial Sequence: Synthetic oligonucleotide
ccugggccauagucauuca

SEQ ID NO: 1583 - RNA, 19 nt, Artificial Sequence
  Description of Artificial Sequence: Synthetic oligonucleotide
cguggagccucucgagcga

SEQ ID NO: 1584 - RNA, 19 nt, Artificial Sequence
  Description of Artificial Sequence: Synthetic oligonucleotide
ccuccugcuucucagcgca

SEQ ID NO: 1585 - RNA, 19 nt, Artificial Sequence
  Description of Artificial Sequence: Synthetic oligonucleotide
agucccagaucaagccuga

SEQ ID NO: 1586 - RNA, 19 nt, Artificial Sequence
  Description of Artificial Sequence: Synthetic oligonucleotide
uaccgugggugucaugaua

SEQ ID NO: 1587 - RNA, 19 nt, Artificial Sequence
  Description of Artificial Sequence: Synthetic oligonucleotide
gccagcccucuucugacaa

SEQ ID NO: 1588 - RNA, 19 nt, Artificial Sequence
  Description of Artificial Sequence: Synthetic oligonucleotide
ccgaggugaagaaaccuga

SEQ ID NO: 1589 - RNA, 19 nt, Artificial Sequence
  Description of Artificial Sequence: Synthetic oligonucleotide
uccuggcacugcggagaaa

SEQ ID NO: 1590 - RNA, 19 nt, Artificial Sequence
  Description of Artificial Sequence: Synthetic oligonucleotide
cccggaaacuccacaucca

SEQ ID NO: 1591 - RNA, 19 nt, Artificial Sequence
  Description of Artificial Sequence: Synthetic oligonucleotide
acucuggucaagaagcaua

SEQ ID NO: 1592 - RNA, 19 nt, Artificial Sequence
  Description of Artificial Sequence: Synthetic oligonucleotide
cccagauaccaugaugcua

SEQ ID NO: 1593 - RNA, 19 nt, Artificial Sequence
  Description of Artificial Sequence: Synthetic oligonucleotide
ccugagacacaugggugca

SEQ ID NO: 1594 - RNA, 19 nt, Artificial Sequence
  Description of Artificial Sequence: Synthetic oligonucleotide
gcacuacaacugcgagcaa

SEQ ID NO: 1595 - RNA, 19 nt, Artificial Sequence
  Description of Artificial Sequence: Synthetic oligonucleotide
ccacaagaugguggacaaa

SEQ ID NO: 1596 - RNA, 19 nt, Artificial Sequence
  Description of Artificial Sequence: Synthetic oligonucleotide
ggacacagauggcaaccca

SEQ ID NO: 1597 - RNA, 19 nt, Artificial Sequence
  Description of Artificial Sequence: Synthetic oligonucleotide
gaaaagcugcuaaccaaaa

SEQ ID NO: 1598 - RNA, 19 nt, Artificial Sequence
  Description of Artificial Sequence: Synthetic oligonucleotide
acuacaacugcgagcacua

SEQ ID NO: 1599 - RNA, 19 nt, Artificial Sequence
  Description of Artificial Sequence: Synthetic oligonucleotide
gcacuccaagaucaacuua

SEQ ID NO: 1600 - RNA, 19 nt, Artificial Sequence
  Description of Artificial Sequence: Synthetic oligonucleotide
gccuugaaaagcugcuaaa

SEQ ID NO: 1601 - RNA, 19 nt, Artificial Sequence
  Description of Artificial Sequence: Synthetic oligonucleotide
gugacucgguccuauacca

SEQ ID NO: 1602 - RNA, 19 nt, Artificial Sequence
  Description of Artificial Sequence: Synthetic oligonucleotide
gugguggaggugacccaua

SEQ ID NO: 1603 - RNA, 19 nt, Artificial Sequence
  Description of Artificial Sequence: Synthetic oligonucleotide
augcgagacgaguuauaga

SEQ ID NO: 1604 - RNA, 19 nt, Artificial Sequence
  Description of Artificial Sequence: Synthetic oligonucleotide
accuucccagcuagaauua

SEQ ID NO: 1605 - RNA, 19 nt, Artificial Sequence
  Description of Artificial Sequence: Synthetic oligonucleotide
cccagcuagaauucacuca

SEQ ID NO: 1606 - RNA, 19 nt, Artificial Sequence
  Description of Artificial Sequence: Synthetic oligonucleotide
ggucaccaaggacguggaa

SEQ ID NO: 1607 - RNA, 19 nt, Artificial Sequence
  Description of Artificial Sequence: Synthetic oligonucleotide
ggccucagggugcacacaa

SEQ ID NO: 1608 - RNA, 19 nt, Artificial Sequence
  Description of Artificial Sequence: Synthetic oligonucleotide
ugagguaccagccuuggaa

SEQ ID NO: 1609 - RNA, 19 nt, Artificial Sequence
  Description of Artificial Sequence: Synthetic oligonucleotide
cauggugacucgguccuaa

SEQ ID NO: 1610 - RNA, 19 nt, Artificial Sequence
  Description of Artificial Sequence: Synthetic oligonucleotide
ggugagguaccagccuuga

SEQ ID NO: 1611 - RNA, 19 nt, Artificial Sequence
  Description of Artificial Sequence: Synthetic oligonucleotide
gccgaggugaagaaaccua

SEQ ID NO: 1612 - RNA, 19 nt, Artificial Sequence
  Description of Artificial Sequence: Synthetic oligonucleotide
guacggacccagcucagua

SEQ ID NO: 1613 - RNA, 19 nt, Artificial Sequence
  Description of Artificial Sequence: Synthetic oligonucleotide
caagaaggaccuguaccua

SEQ ID NO: 1614 - RNA, 19 nt, Artificial Sequence
  Description of Artificial Sequence: Synthetic oligonucleotide
gagcacuccaagaucaaca

SEQ ID NO: 1615 - RNA, 19 nt, Artificial Sequence
  Description of Artificial Sequence: Synthetic oligonucleotide
cauguucuucaagccacaa

SEQ ID NO: 1616 - RNA, 19 nt, Artificial Sequence
  Description of Artificial Sequence: Synthetic oligonucleotide
cccuccugcuucucagcga

SEQ ID NO: 1617 - RNA, 19 nt, Artificial Sequence
  Description of Artificial Sequence: Synthetic oligonucleotide
augucaggcaagaaggaca

SEQ ID NO: 1618 - RNA, 19 nt, Artificial Sequence
  Description of Artificial Sequence: Synthetic oligonucleotide
caagaucaacuuccgcgaa

SEQ ID NO: 1619 - RNA, 19 nt, Artificial Sequence
  Description of Artificial Sequence: Synthetic oligonucleotide
gcguguuccacgccaccga

SEQ ID NO: 1620 - RNA, 19 nt, Artificial Sequence
  Description of Artificial Sequence: Synthetic oligonucleotide
cggacccagcucagugaga

SEQ ID NO: 1621 - RNA, 19 nt, Artificial Sequence
  Description of Artificial Sequence: Synthetic oligonucleotide
ccuucagcuuguaccagga

SEQ ID NO: 1622 - RNA, 19 nt, Artificial Sequence
  Description of Artificial Sequence: Synthetic oligonucleotide
gcucuccagccucaucaua

SEQ ID NO: 1623 - RNA, 19 nt, Artificial Sequence
  Description of Artificial Sequence: Synthetic oligonucleotide
cccuggcccacaagcucua

SEQ ID NO: 1624 - RNA, 19 nt, Artificial Sequence
  Description of Artificial Sequence: Synthetic oligonucleotide
gcccgaggucaccaaggaa

SEQ ID NO: 1625 - RNA, 19 nt, Artificial Sequence
  Description of Artificial Sequence: Synthetic oligonucleotide
guggagaacauccugguga

SEQ ID NO: 1626 - RNA, 19 nt, Artificial Sequence
  Description of Artificial Sequence: Synthetic oligonucleotide
gcucacucagcaacuccaa

SEQ ID NO: 1627 - RNA, 19 nt, Artificial Sequence
  Description of Artificial Sequence: Synthetic oligonucleotide
acgccauguucuucaagca

SEQ ID NO: 1628 - RNA, 19 nt, Artificial Sequence
  Description of Artificial Sequence: Synthetic oligonucleotide
acacaugggugcuauugga

SEQ ID NO: 1629 - RNA, 19 nt, Artificial Sequence
  Description of Artificial Sequence: Synthetic oligonucleotide
ccagcucagugagcuucga

SEQ ID NO: 1630 - RNA, 19 nt, Artificial Sequence
  Description of Artificial Sequence: Synthetic oligonucleotide
cccagcucagugagcuuca

SEQ ID NO: 1631 - RNA, 19 nt, Artificial Sequence
  Description of Artificial Sequence: Synthetic oligonucleotide
gggcggcaaggcgaccaca

SEQ ID NO: 1632 - RNA, 19 nt, Artificial Sequence
  Description of Artificial Sequence: Synthetic oligonucleotide
cagggugcacacaggauga

SEQ ID NO: 1633 - RNA, 19 nt, Artificial Sequence
  Description of Artificial Sequence: Synthetic oligonucleotide
aggugaagaaaccugcaga

SEQ ID NO: 1634 - RNA, 19 nt, Artificial Sequence
  Description of Artificial Sequence: Synthetic oligonucleotide
ccucucccaacuauaaaaa

SEQ ID NO: 1635 - RNA, 19 nt, Artificial Sequence
  Description of Artificial Sequence: Synthetic oligonucleotide
gacuguacggacccagcua

SEQ ID NO: 1636 - RNA, 19 nt, Artificial Sequence
  Description of Artificial Sequence: Synthetic oligonucleotide
gaaggagcucccaggagga

SEQ ID NO: 1637 - RNA, 19 nt, Artificial Sequence
  Description of Artificial Sequence: Synthetic oligonucleotide
acgcaugucaggcaagaaa

SEQ ID NO: 1638 - RNA, 19 nt, Artificial Sequence
  Description of Artificial Sequence: Synthetic oligonucleotide
gacucgguccuauaccgua

SEQ ID NO: 1639 - RNA, 19 nt, Artificial Sequence
  Description of Artificial Sequence: Synthetic oligonucleotide
cacuacaacugcgagcaca

SEQ ID NO: 1640 - RNA, 19 nt, Artificial Sequence
  Description of Artificial Sequence: Synthetic oligonucleotide
agcuccuggcacugcggaa

SEQ ID NO: 1641 - RNA, 19 nt, Artificial Sequence
  Description of Artificial Sequence: Synthetic oligonucleotide
cuaagggugacaagaugca

SEQ ID NO: 1642 - RNA, 19 nt, Artificial Sequence
  Description of Artificial Sequence: Synthetic oligonucleotide
ugugagaccaaauugagca

SEQ ID NO: 1643 - RNA, 19 nt, Artificial Sequence
  Description of Artificial Sequence: Synthetic oligonucleotide
gccgacuugucacgcauga

SEQ ID NO: 1644 - RNA, 19 nt, Artificial Sequence
  Description of Artificial Sequence: Synthetic oligonucleotide
caggauggcaggaggcaua

SEQ ID NO: 1645 - RNA, 19 nt, Artificial Sequence
  Description of Artificial Sequence: Synthetic oligonucleotide
acaagaacaaggccgacua

SEQ ID NO: 1646 - RNA, 19 nt, Artificial Sequence
  Description of Artificial Sequence: Synthetic oligonucleotide
ugcgcucccuccugcuuca

SEQ ID NO: 1647 - RNA, 19 nt, Artificial Sequence
  Description of Artificial Sequence: Synthetic oligonucleotide
ggcgagcugcugcgcucaa

SEQ ID NO: 1648 - RNA, 19 nt, Artificial Sequence
  Description of Artificial Sequence: Synthetic oligonucleotide
gaugcaccggacaggccua

SEQ ID NO: 1649 - RNA, 19 nt, Artificial Sequence
  Description of Artificial Sequence: Synthetic oligonucleotide
cgugucgcugggcggcaaa

SEQ ID NO: 1650 - RNA, 19 nt, Artificial Sequence
  Description of Artificial Sequence: Synthetic oligonucleotide
aucccaaccucucccaaca

SEQ ID NO: 1651 - RNA, 19 nt, Artificial Sequence
  Description of Artificial Sequence: Synthetic oligonucleotide
uguucuacgccgaccacca

SEQ ID NO: 1652 - RNA, 19 nt, Artificial Sequence
  Description of Artificial Sequence: Synthetic oligonucleotide
cggccuggccuucagcuua

SEQ ID NO: 1653 - RNA, 19 nt, Artificial Sequence
  Description of Artificial Sequence: Synthetic oligonucleotide
gucgcaggccaaggcagua

SEQ ID NO: 1654 - RNA, 19 nt, Artificial Sequence
  Description of Artificial Sequence: Synthetic oligonucleotide
agucauucugccugcccua

SEQ ID NO: 1655 - RNA, 19 nt, Artificial Sequence
  Description of Artificial Sequence: Synthetic oligonucleotide
cccagaaugaccuggccga

SEQ ID NO: 1656 - RNA, 19 nt, Artificial Sequence
  Description of Artificial Sequence: Synthetic oligonucleotide
acaagaugguggacaacca

SEQ ID NO: 1657 - RNA, 19 nt, Artificial Sequence
  Description of Artificial Sequence: Synthetic oligonucleotide
gcuagucaacgccauguua

SEQ ID NO: 1658 - RNA, 19 nt, Artificial Sequence
  Description of Artificial Sequence: Synthetic oligonucleotide
acgccaccgccuuugagua

SEQ ID NO: 1659 - RNA, 19 nt, Artificial Sequence
  Description of Artificial Sequence: Synthetic oligonucleotide
gccgcgcagaccaccgaca

SEQ ID NO: 1660 - RNA, 19 nt, Artificial Sequence
  Description of Artificial Sequence: Synthetic oligonucleotide
gcuauucauugggcgccua

SEQ ID NO: 1661 - RNA, 19 nt, Artificial Sequence
  Description of Artificial Sequence: Synthetic oligonucleotide
cucagugagcuucgcugaa

SEQ ID NO: 1662 - RNA, 19 nt, Artificial Sequence
  Description of Artificial Sequence: Synthetic oligonucleotide
ggaggugagguaccagcca

SEQ ID NO: 1663 - RNA, 19 nt, Artificial Sequence
  Description of Artificial Sequence: Synthetic oligonucleotide
gccaaggcagugcugagca

SEQ ID NO: 1664 - RNA, 19 nt, Artificial Sequence
  Description of Artificial Sequence: Synthetic oligonucleotide
cucuccagccucaucauca

SEQ ID NO: 1665 - RNA, 19 nt, Artificial Sequence
  Description of Artificial Sequence: Synthetic oligonucleotide
gaaugaccuggccgcagua

SEQ ID NO: 1666 - RNA, 19 nt, Artificial Sequence
  Description of Artificial Sequence: Synthetic oligonucleotide
uggugacucgguccuauaa

SEQ ID NO: 1667 - RNA, 19 nt, Artificial Sequence
  Description of Artificial Sequence: Synthetic oligonucleotide
cagguaccuucucaccuga

SEQ ID NO: 1668 - RNA, 19 nt, Artificial Sequence
  Description of Artificial Sequence: Synthetic oligonucleotide
guuccacgccaccgccuua

SEQ ID NO: 1669 - RNA, 19 nt, Artificial Sequence
  Description of Artificial Sequence: Synthetic oligonucleotide
ccgacuguacggacccaga

SEQ ID NO: 1670 - RNA, 19 nt, Artificial Sequence
  Description of Artificial Sequence: Synthetic oligonucleotide
gcagaccaccgacggcaaa

SEQ ID NO: 1671 - RNA, 19 nt, Artificial Sequence
  Description of Artificial Sequence: Synthetic oligonucleotide
aagaugcgagacgaguuaa

SEQ ID NO: 1672 - RNA, 19 nt, Artificial Sequence
  Description of Artificial Sequence: Synthetic oligonucleotide
caaagagcagcugaagaua

SEQ ID NO: 1673 - RNA, 19 nt, Artificial Sequence
  Description of Artificial Sequence: Synthetic oligonucleotide
acgacgagaaggaaaagca

SEQ ID NO: 1674 - RNA, 19 nt, Artificial Sequence
  Description of Artificial Sequence: Synthetic oligonucleotide
cacuccacuuggacaugga

SEQ ID NO: 1675 - RNA, 19 nt, Artificial Sequence
  Description of Artificial Sequence: Synthetic oligonucleotide
aguccaucaacgaguggga

SEQ ID NO: 1676 - RNA, 19 nt, Artificial Sequence
  Description of Artificial Sequence: Synthetic oligonucleotide
gcgccggccuggccuucaa

SEQ ID NO: 1677 - RNA, 19 nt, Artificial Sequence
  Description of Artificial Sequence: Synthetic oligonucleotide
ggaaaagcugcaaaucgua

SEQ ID NO: 1678 - RNA, 19 nt, Artificial Sequence
  Description of Artificial Sequence: Synthetic oligonucleotide
acauuuuguuggagcguga

SEQ ID NO: 1679 - RNA, 19 nt, Artificial Sequence
  Description of Artificial Sequence: Synthetic oligonucleotide
accguggcuucauggugaa

SEQ ID NO: 1680 - RNA, 19 nt, Artificial Sequence
  Description of Artificial Sequence: Synthetic oligonucleotide
cccuucaucuuccuaguga

SEQ ID NO: 1681 - RNA, 19 nt, Artificial Sequence
  Description of Artificial Sequence: Synthetic oligonucleotide
gaaauuccaccacaagaua

SEQ ID NO: 1682 - RNA, 19 nt, Artificial Sequence
  Description of Artificial Sequence: Synthetic oligonucleotide
cuauaaaacuaggugcuga

SEQ ID NO: 1683 - RNA, 19 nt, Artificial Sequence
  Description of Artificial Sequence: Synthetic oligonucleotide
ggaggugcacgccggccua

SEQ ID NO: 1684 - RNA, 19 nt, Artificial Sequence
  Description of Artificial Sequence: Synthetic oligonucleotide
gcaggccaaggcagugcua

SEQ ID NO: 1685 - RNA, 19 nt, Artificial Sequence
  Description of Artificial Sequence: Synthetic oligonucleotide
ugagaccaaauugagcuaa

SEQ ID NO: 1686 - RNA, 19 nt, Artificial Sequence
  Description of Artificial Sequence: Synthetic oligonucleotide
gccauagucauucugccua

SEQ ID NO: 1687 - RNA, 19 nt, Artificial Sequence
  Description of Artificial Sequence: Synthetic oligonucleotide
agcugaagaucuggaugga

SEQ ID NO: 1688 - RNA, 19 nt, Artificial Sequence
  Description of Artificial Sequence: Synthetic oligonucleotide
ccaucuccuugcccaagga

SEQ ID NO: 1689 - RNA, 19 nt, Artificial Sequence
  Description of Artificial Sequence: Synthetic oligonucleotide
cccagaucaagccugccua

SEQ ID NO: 1690 - RNA, 19 nt, Artificial Sequence
  Description of Artificial Sequence: Synthetic oligonucleotide
gcuguugccaucuccuuga

SEQ ID NO: 1691 - RNA, 19 nt, Artificial Sequence
  Description of Artificial Sequence: Synthetic oligonucleotide
cgaggucaccaaggacgua

SEQ ID NO: 1692 - RNA, 19 nt, Artificial Sequence
  Description of Artificial Sequence: Synthetic oligonucleotide
caacuauaaaacuagguga

SEQ ID NO: 1693 - RNA, 19 nt, Artificial Sequence
  Description of Artificial Sequence: Synthetic oligonucleotide
gaaggcuguugccaucuca

SEQ ID NO: 1694 - RNA, 19 nt, Artificial Sequence
  Description of Artificial Sequence: Synthetic oligonucleotide
ugcggagaaguugagccca

SEQ ID NO: 1695 - RNA, 19 nt, Artificial Sequence
  Description of Artificial Sequence: Synthetic oligonucleotide
cuccuugcccaagggugua

SEQ ID NO: 1696 - RNA, 19 nt, Artificial Sequence
  Description of Artificial Sequence: Synthetic oligonucleotide
gcccugaaagucccagaua

SEQ ID NO: 1697 - RNA, 19 nt, Artificial Sequence
  Description of Artificial Sequence: Synthetic oligonucleotide
caagggugugguggaggua

SEQ ID NO: 1698 - RNA, 19 nt, Artificial Sequence
  Description of Artificial Sequence: Synthetic oligonucleotide
aagagcagcugaagaucua

SEQ ID NO: 1699 - RNA, 19 nt, Artificial Sequence
  Description of Artificial Sequence: Synthetic oligonucleotide
gaagaugcagaagaaggca

SEQ ID NO: 1700 - RNA, 19 nt, Artificial Sequence
  Description of Artificial Sequence: Synthetic oligonucleotide
cggaaacuccacauccuga

SEQ ID NO: 1701 - RNA, 19 nt, Artificial Sequence
  Description of Artificial Sequence: Synthetic oligonucleotide
agucaacgccauguucuua

SEQ ID NO: 1702 - RNA, 19 nt, Artificial Sequence
  Description of Artificial Sequence: Synthetic oligonucleotide
cgagcgccuugaaaagcua

SEQ ID NO: 1703 - RNA, 19 nt, Artificial Sequence
  Description of Artificial Sequence: Synthetic oligonucleotide
auaccgugggugucaugaa

SEQ ID NO: 1704 - RNA, 19 nt, Artificial Sequence
  Description of Artificial Sequence: Synthetic oligonucleotide
gaccugggccauagucaua

SEQ ID NO: 1705 - RNA, 19 nt, Artificial Sequence
  Description of Artificial Sequence: Synthetic oligonucleotide
caugucaggcaagaaggaa

SEQ ID NO: 1706 - RNA, 19 nt, Artificial Sequence
  Description of Artificial Sequence: Synthetic oligonucleotide
ugcgagacgaguuauagga

SEQ ID NO: 1707 - RNA, 19 nt, Artificial Sequence
  Description of Artificial Sequence: Synthetic oligonucleotide
cgcaacgugaccuggaaga

SEQ ID NO: 1708 - RNA, 19 nt, Artificial Sequence
  Description of Artificial Sequence: Synthetic oligonucleotide
agcaagcagcacuacaaca

SEQ ID NO: 1709 - RNA, 19 nt, Artificial Sequence
  Description of Artificial Sequence: Synthetic oligonucleotide
gcugcugcgcucacucaga

SEQ ID NO: 1710 - RNA, 19 nt, Artificial Sequence
  Description of Artificial Sequence: Synthetic oligonucleotide
ugaugaugcaccggacaga

SEQ ID NO: 1711 - RNA, 19 nt, Artificial Sequence
  Description of Artificial Sequence: Synthetic oligonucleotide
uuguugcuaucaauccaaa

SEQ ID NO: 1712 - RNA, 19 nt, Artificial Sequence
  Description of Artificial Sequence: Synthetic oligonucleotide
ccuugaaaagcugcuaaca

SEQ ID NO: 1713 - RNA, 19 nt, Artificial Sequence
  Description of Artificial Sequence: Synthetic oligonucleotide
cccuuugaccaggacauca

SEQ ID NO: 1714 - RNA, 19 nt, Artificial Sequence
  Description of Artificial Sequence: Synthetic oligonucleotide
gaggugaagaaaccugcaa

SEQ ID NO: 1715 - RNA, 19 nt, Artificial Sequence
  Description of Artificial Sequence: Synthetic oligonucleotide
cccaagggugugguggaga

SEQ ID NO: 1716 - RNA, 19 nt, Artificial Sequence
  Description of Artificial Sequence: Synthetic oligonucleotide
cccugcuauucauugggca

SEQ ID NO: 1717 - RNA, 19 nt, Artificial Sequence
  Description of Artificial Sequence: Synthetic oligonucleotide
cugaaagucccagaucaaa

SEQ ID NO: 1718 - RNA, 19 nt, Artificial Sequence
  Description of Artificial Sequence: Synthetic oligonucleotide
gcugcaaaucguggagaua

SEQ ID NO: 1719 - RNA, 19 nt, Artificial Sequence
  Description of Artificial Sequence: Synthetic oligonucleotide
caagccugccucaaucaga

SEQ ID NO: 1720 - RNA, 19 nt, Artificial Sequence
  Description of Artificial Sequence: Synthetic oligonucleotide
cgagcagcugcgcgacgaa

SEQ ID NO: 1721 - RNA, 19 nt, Artificial Sequence
  Description of Artificial Sequence: Synthetic oligonucleotide
aggccgacuugucacgcaa

SEQ ID NO: 1722 - RNA, 19 nt, Artificial Sequence
  Description of Artificial Sequence: Synthetic oligonucleotide
gcagcagcuccuggcacua

SEQ ID NO: 1723 - RNA, 19 nt, Artificial Sequence
  Description of Artificial Sequence: Synthetic oligonucleotide
ggccauagucauucugcca

SEQ ID NO: 1724 - RNA, 19 nt, Artificial Sequence
  Description of Artificial Sequence: Synthetic oligonucleotide
cccgugugccugagcggaa

SEQ ID NO: 1725 - RNA, 19 nt, Artificial Sequence
  Description of Artificial Sequence: Synthetic oligonucleotide
cagcugaagaucuggauga

SEQ ID NO: 1726 - RNA, 19 nt, Artificial Sequence
  Description of Artificial Sequence: Synthetic oligonucleotide
caagccacacugggaugaa

SEQ ID NO: 1727 - RNA, 19 nt, Artificial Sequence
  Description of Artificial Sequence: Synthetic oligonucleotide
gaauucacuccacuuggaa

SEQ ID NO: 1728 - RNA, 19 nt, Artificial Sequence
  Description of Artificial Sequence: Synthetic oligonucleotide
cggcgcccugcuagucaaa

SEQ ID NO: 1729 - RNA, 19 nt, Artificial Sequence
  Description of Artificial Sequence: Synthetic oligonucleotide
uggaagcugggcagccgaa

SEQ ID NO: 1730 - RNA, 19 nt, Artificial Sequence
  Description of Artificial Sequence: Synthetic oligonucleotide
ggcaaggcgaccacggcga

SEQ ID NO: 1731 - RNA, 19 nt, Artificial Sequence
  Description of Artificial Sequence: Synthetic oligonucleotide
cacugcggagaaguugaga

SEQ ID NO: 1732 - RNA, 19 nt, Artificial Sequence
  Description of Artificial Sequence: Synthetic oligonucleotide
ggcaggaggcauccaaaga

SEQ ID NO: 1733 - RNA, 19 nt, Artificial Sequence
  Description of Artificial Sequence: Synthetic oligonucleotide
ggugacucgguccuauaca

SEQ ID NO: 1734 - RNA, 19 nt, Artificial Sequence
  Description of Artificial Sequence: Synthetic oligonucleotide
uuuauagccagguaccuua

SEQ ID NO: 1735 - RNA, 19 nt, Artificial Sequence
  Description of Artificial Sequence: Synthetic oligonucleotide
ggccauggccaaggaccaa

SEQ ID NO: 1736 - RNA, 19 nt, Artificial Sequence
  Description of Artificial Sequence: Synthetic oligonucleotide
caaagauagggagggaaga

SEQ ID NO: 1737 - RNA, 19 nt, Artificial Sequence
  Description of Artificial Sequence: Synthetic oligonucleotide
ucuucugacacuaaaacaa

SEQ ID NO: 1738 - RNA, 19 nt, Artificial Sequence
  Description of Artificial Sequence: Synthetic oligonucleotide
cuucugacacuaaaacaca

SEQ ID NO: 1739 - RNA, 19 nt, Artificial Sequence
  Description of Artificial Sequence: Synthetic oligonucleotide
ucacguggagccucucgaa

SEQ ID NO: 1740 - RNA, 19 nt, Artificial Sequence
  Description of Artificial Sequence: Synthetic oligonucleotide
caguccaucaacgagugga

SEQ ID NO: 1741 - RNA, 19 nt, Artificial Sequence
  Description of Artificial Sequence: Synthetic oligonucleotide
agaccaaauugagcuagga

SEQ ID NO: 1742 - RNA, 19 nt, Artificial Sequence
  Description of Artificial Sequence: Synthetic oligonucleotide
ggguucccgugugccugaa

SEQ ID NO: 1743 - RNA, 19 nt, Artificial Sequence
  Description of Artificial Sequence: Synthetic oligonucleotide
uugcuaucaauccaagaaa

SEQ ID NO: 1744 - RNA, 19 nt, Artificial Sequence
  Description of Artificial Sequence: Synthetic oligonucleotide
caaccguggcuucauggua

SEQ ID NO: 1745 - RNA, 19 nt, Artificial Sequence
  Description of Artificial Sequence: Synthetic oligonucleotide
cuguacggacccagcucaa

SEQ ID NO: 1746 - RNA, 19 nt, Artificial Sequence
  Description of Artificial Sequence: Synthetic oligonucleotide
cagcagcaagcagcacuaa

SEQ ID NO: 1747 - RNA, 19 nt, Artificial Sequence
  Description of Artificial Sequence: Synthetic oligonucleotide
ccugcagccgcagcagcua

SEQ ID NO: 1748 - RNA, 19 nt, Artificial Sequence
  Description of Artificial Sequence: Synthetic oligonucleotide
gacacuaaaacaccucaga

SEQ ID NO: 1749 - RNA, 19 nt, Artificial Sequence
  Description of Artificial Sequence: Synthetic oligonucleotide
caacugcgagcacuccaaa

SEQ ID NO: 1750 - RNA, 19 nt, Artificial Sequence
  Description of Artificial Sequence: Synthetic oligonucleotide
acugcggagaaguugagca

SEQ ID NO: 1751 - RNA, 19 nt, Artificial Sequence
  Description of Artificial Sequence: Synthetic oligonucleotide
gcgcccugcuagucaacga

SEQ ID NO: 1752 - RNA, 19 nt, Artificial Sequence
  Description of Artificial Sequence: Synthetic oligonucleotide
ggaagcugggcagccgaca

SEQ ID NO: 1753 - RNA, 19 nt, Artificial Sequence
  Description of Artificial Sequence: Synthetic oligonucleotide
aggcuccugagacacauga

SEQ ID NO: 1754 - RNA, 19 nt, Artificial Sequence
  Description of Artificial Sequence: Synthetic oligonucleotide
cgacaagcgcagcgcgcua

SEQ ID NO: 1755 - RNA, 19 nt, Artificial Sequence
  Description of Artificial Sequence: Synthetic oligonucleotide
ucagugagcuucgcugaua

SEQ ID NO: 1756 - RNA, 19 nt, Artificial Sequence
  Description of Artificial Sequence: Synthetic oligonucleotide
uugagaaggagcucccaga

SEQ ID NO: 1757 - RNA, 19 nt, Artificial Sequence
  Description of Artificial Sequence: Synthetic oligonucleotide
acugcgagcacuccaagaa

SEQ ID NO: 1758 - RNA, 19 nt, Artificial Sequence
  Description of Artificial Sequence: Synthetic oligonucleotide
cauccuggugucacccgua

SEQ ID NO: 1759 - RNA, 19 nt, Artificial Sequence
  Description of Artificial Sequence: Synthetic oligonucleotide
gugcgcagcagcaagcaga

SEQ ID NO: 1760 - RNA, 19 nt, Artificial Sequence
  Description of Artificial Sequence: Synthetic oligonucleotide
cacgccaccgccuuugaga

SEQ ID NO: 1761 - RNA, 19 nt, Artificial Sequence
  Description of Artificial Sequence: Synthetic oligonucleotide
ucucgagcgccuugaaaaa

SEQ ID NO: 1762 - RNA, 19 nt, Artificial Sequence
  Description of Artificial Sequence: Synthetic oligonucleotide
gcuucgcugaugacuucga

SEQ ID NO: 1763 - RNA, 19 nt, Artificial Sequence
  Description of Artificial Sequence: Synthetic oligonucleotide
ucuccuugcccaaggguga

SEQ ID NO: 1764 - RNA, 19 nt, Artificial Sequence
  Description of Artificial Sequence: Synthetic oligonucleotide
gcaguccaucaacgaguga

SEQ ID NO: 1765 - RNA, 19 nt, Artificial Sequence
  Description of Artificial Sequence: Synthetic oligonucleotide
agaugguggacaaccguga

SEQ ID NO: 1766 - RNA, 19 nt, Artificial Sequence
  Description of Artificial Sequence: Synthetic oligonucleotide
cggcucccugcuauucaua

SEQ ID NO: 1767 - RNA, 19 nt, Artificial Sequence
  Description of Artificial Sequence: Synthetic oligonucleotide
auaccaugaugcugagcca

SEQ ID NO: 1768 - RNA, 19 nt, Artificial Sequence
  Description of Artificial Sequence: Synthetic oligonucleotide
agccagguaccuucucaca

SEQ ID NO: 1769 - RNA, 19 nt, Artificial Sequence
  Description of Artificial Sequence: Synthetic oligonucleotide
gagcccggaaacuccacaa

SEQ ID NO: 1770 - RNA, 19 nt, Artificial Sequence
  Description of Artificial Sequence: Synthetic oligonucleotide
gcagcuccuggcacugcga

SEQ ID NO: 1771 - RNA, 19 nt, Artificial Sequence
  Description of Artificial Sequence: Synthetic oligonucleotide
cccgaggucaccaaggaca

SEQ ID NO: 1772 - RNA, 19 nt, Artificial Sequence
  Description of Artificial Sequence: Synthetic oligonucleotide
ccugacugaggccauugaa

SEQ ID NO: 1773 - RNA, 19 nt, Artificial Sequence
  Description of Artificial Sequence: Synthetic oligonucleotide
ugcugagcccggaaacuca

SEQ ID NO: 1774 - RNA, 19 nt, Artificial Sequence
  Description of Artificial Sequence: Synthetic oligonucleotide
gccaucuccuugcccaaga

SEQ ID NO: 1775 - RNA, 19 nt, Artificial Sequence
  Description of Artificial Sequence: Synthetic oligonucleotide
caagcagcacuacaacuga

SEQ ID NO: 1776 - RNA, 19 nt, Artificial Sequence
  Description of Artificial Sequence: Synthetic oligonucleotide
caaggcagugcugagcgca

SEQ ID NO: 1777 - RNA, 19 nt, Artificial Sequence
  Description of Artificial Sequence: Synthetic oligonucleotide
caaugacauuuuguuggaa

SEQ ID NO: 1778 - RNA, 19 nt, Artificial Sequence
  Description of Artificial Sequence: Synthetic oligonucleotide
agugagcuucgcugaugaa

SEQ ID NO: 1779 - RNA, 19 nt, Artificial Sequence
  Description of Artificial Sequence: Synthetic oligonucleotide
augaugaugcaccggacaa

SEQ ID NO: 1780 - RNA, 19 nt, Artificial Sequence
  Description of Artificial Sequence: Synthetic oligonucleotide
gaaacaccuggcugggcua

SEQ ID NO: 1781 - RNA, 19 nt, Artificial Sequence
  Description of Artificial Sequence: Synthetic oligonucleotide
ccugcuauucauugggcga

SEQ ID NO: 1782 - RNA, 19 nt, Artificial Sequence
  Description of Artificial Sequence: Synthetic oligonucleotide
cgccaccgccuuugaguua

SEQ ID NO: 1783 - RNA, 19 nt, Artificial Sequence
  Description of Artificial Sequence: Synthetic oligonucleotide
gcuucucagcgccuucuga

SEQ ID NO: 1784 - RNA, 19 nt, Artificial Sequence
  Description of Artificial Sequence: Synthetic oligonucleotide
ugaugcugagcccggaaaa

SEQ ID NO: 1785 - RNA, 19 nt, Artificial Sequence
  Description of Artificial Sequence: Synthetic oligonucleotide
ugaccuggccgcagugaga

SEQ ID NO: 1786 - RNA, 19 nt, Artificial Sequence
  Description of Artificial Sequence: Synthetic oligonucleotide
ugcagaaacaccuggcuga

SEQ ID NO: 1787 - RNA, 19 nt, Artificial Sequence
  Description of Artificial Sequence: Synthetic oligonucleotide
gcagugcugagcgccgaga

SEQ ID NO: 1788 - RNA, 19 nt, Artificial Sequence
  Description of Artificial Sequence: Synthetic oligonucleotide
cggcgcgcaacgugaccua

SEQ ID NO: 1789 - RNA, 19 nt, Artificial Sequence
  Description of Artificial Sequence: Synthetic oligonucleotide
agugcugagcgccgagcaa

SEQ ID NO: 1790 - RNA, 19 nt, Artificial Sequence
  Description of Artificial Sequence: Synthetic oligonucleotide
acaggccucuacaacuaca

SEQ ID NO: 1791 - RNA, 19 nt, Artificial Sequence
  Description of Artificial Sequence: Synthetic oligonucleotide
gcagcugcgcgacgaggaa

SEQ ID NO: 1792 - RNA, 19 nt, Artificial Sequence
  Description of Artificial Sequence: Synthetic oligonucleotide
auugagaaggagcucccaa

SEQ ID NO: 1793 - RNA, 19 nt, Artificial Sequence
  Description of Artificial Sequence: Synthetic oligonucleotide
cgcgcagaccaccgacgga

SEQ ID NO: 1794 - RNA, 19 nt, Artificial Sequence
  Description of Artificial Sequence: Synthetic oligonucleotide
ccuguaccuggccagcgua

SEQ ID NO: 1795 - RNA, 19 nt, Artificial Sequence
  Description of Artificial Sequence: Synthetic oligonucleotide
cugagcggaccuucccaga

SEQ ID NO: 1796 - RNA, 19 nt, Artificial Sequence
  Description of Artificial Sequence: Synthetic oligonucleotide
ggccuucagcuuguaccaa

SEQ ID NO: 1797 - RNA, 19 nt, Artificial Sequence
  Description of Artificial Sequence: Synthetic oligonucleotide
cacccaaagcggcucccua

SEQ ID NO: 1798 - RNA, 19 nt, Artificial Sequence
  Description of Artificial Sequence: Synthetic oligonucleotide
gccaaggaccaggcaguga

SEQ ID NO: 1799 - RNA, 19 nt, Artificial Sequence
  Description of Artificial Sequence: Synthetic oligonucleotide
cucagggugcacacaggaa

SEQ ID NO: 1800 - RNA, 19 nt, Artificial Sequence
  Description of Artificial Sequence: Synthetic oligonucleotide
cgagcugcugcgcucacua

SEQ ID NO: 1801 - RNA, 19 nt, Artificial Sequence
  Description of Artificial Sequence: Synthetic oligonucleotide
ggcugggccugacugagga

SEQ ID NO: 1802 - RNA, 19 nt, Artificial Sequence
  Description of Artificial Sequence: Synthetic oligonucleotide
ccgcagcagcuccuggcaa

SEQ ID NO: 1803 - RNA, 19 nt, Artificial Sequence
  Description of Artificial Sequence: Synthetic oligonucleotide
ugugggaccugggccauaa

SEQ ID NO: 1804 - RNA, 19 nt, Artificial Sequence
  Description of Artificial Sequence: Synthetic oligonucleotide
aagaugcagaagaaggcua

SEQ ID NO: 1805 - RNA, 19 nt, Artificial Sequence
  Description of Artificial Sequence: Synthetic oligonucleotide
ccacggcgcgcaacgugaa

SEQ ID NO: 1806 - RNA, 19 nt, Artificial Sequence
  Description of Artificial Sequence: Synthetic oligonucleotide
accuucucaccugugagaa

SEQ ID NO: 1807 - RNA, 19 nt, Artificial Sequence
  Description of Artificial Sequence: Synthetic oligonucleotide
ugaagaaaccugcagccga

SEQ ID NO: 1808 - RNA, 19 nt, Artificial Sequence
  Description of Artificial Sequence: Synthetic oligonucleotide
cagcacuacaacugcgaga

SEQ ID NO: 1809 - RNA, 19 nt, Artificial Sequence
  Description of Artificial Sequence: Synthetic oligonucleotide
gcgacaagcgcagcgcgca

SEQ ID NO: 1810 - RNA, 19 nt, Artificial Sequence
  Description of Artificial Sequence: Synthetic oligonucleotide
uagaauucacuccacuuga

SEQ ID NO: 1811 - RNA, 19 nt, Artificial Sequence
  Description of Artificial Sequence: Synthetic oligonucleotide
guggaaaaacagaccggga

SEQ ID NO: 1812 - RNA, 19 nt, Artificial Sequence
  Description of Artificial Sequence: Synthetic oligonucleotide
acguggagccucucgagca

SEQ ID NO: 1813 - RNA, 19 nt, Artificial Sequence
  Description of Artificial Sequence: Synthetic oligonucleotide
ggcgcgcaacgugaccuga

SEQ ID NO: 1814 - RNA, 19 nt, Artificial Sequence
  Description of Artificial Sequence: Synthetic oligonucleotide
uggacaaccguggcuucaa

SEQ ID NO: 1815 - RNA, 19 nt, Artificial Sequence
  Description of Artificial Sequence: Synthetic oligonucleotide
cuagucaacgccauguuca

SEQ ID NO: 1816 - RNA, 19 nt, Artificial Sequence
  Description of Artificial Sequence: Synthetic oligonucleotide
agaaugaccuggccgcaga

SEQ ID NO: 1817 - RNA, 19 nt, Artificial Sequence
  Description of Artificial Sequence: Synthetic oligonucleotide
agcugcugcgcucacucaa

SEQ ID NO: 1818 - RNA, 19 nt, Artificial Sequence
  Description of Artificial Sequence: Synthetic oligonucleotide
cucuaucccaaccucucca

SEQ ID NO: 1819 - RNA, 19 nt, Artificial Sequence
  Description of Artificial Sequence: Synthetic oligonucleotide
gcgagcugcugcgcucaca

SEQ ID NO: 1820 - RNA, 19 nt, Artificial Sequence
  Description of Artificial Sequence: Synthetic oligonucleotide
cgcagcagcaagcagcaca

SEQ ID NO: 1821 - RNA, 19 nt, Artificial Sequence
  Description of Artificial Sequence: Synthetic oligonucleotide
ggcugggcugggccugaca

SEQ ID NO: 1822 - RNA, 19 nt, Artificial Sequence
  Description of Artificial Sequence: Synthetic oligonucleotide
ucuccagccucaucaucca

SEQ ID NO: 1823 - RNA, 19 nt, Artificial Sequence
  Description of Artificial Sequence: Synthetic oligonucleotide
caacgccauguucuucaaa

SEQ ID NO: 1824 - RNA, 19 nt, Artificial Sequence
  Description of Artificial Sequence: Synthetic oligonucleotide
uggcacugcggagaaguua

SEQ ID NO: 1825 - RNA, 19 nt, Artificial Sequence
  Description of Artificial Sequence: Synthetic oligonucleotide
uuugaguuggacacagaua

SEQ ID NO: 1826 - RNA, 19 nt, Artificial Sequence
  Description of Artificial Sequence: Synthetic oligonucleotide
ugggcgagcugcugcgcua

SEQ ID NO: 1827 - RNA, 19 nt, Artificial Sequence
  Description of Artificial Sequence: Synthetic oligonucleotide
cugcuaaccaaagagcaga

SEQ ID NO: 1828 - RNA, 19 nt, Artificial Sequence
  Description of Artificial Sequence: Synthetic oligonucleotide
aacgugaccuggaagcuga

SEQ ID NO: 1829 - RNA, 19 nt, Artificial Sequence
  Description of Artificial Sequence: Synthetic oligonucleotide
augacauuuuguuggagca

SEQ ID NO: 1830 - RNA, 19 nt, Artificial Sequence
  Description of Artificial Sequence: Synthetic oligonucleotide
caggaggcauccaaaggca

SEQ ID NO: 1831 - RNA, 19 nt, Artificial Sequence
  Description of Artificial Sequence: Synthetic oligonucleotide
aucuccuugcccaagggua

SEQ ID NO: 1832 - RNA, 19 nt, Artificial Sequence
  Description of Artificial Sequence: Synthetic oligonucleotide
ugggaugagaaauuccaca

SEQ ID NO: 1833 - RNA, 19 nt, Artificial Sequence
  Description of Artificial Sequence: Synthetic oligonucleotide
aaagcugcuaaccaaagaa

SEQ ID NO: 1834 - RNA, 19 nt, Artificial Sequence
  Description of Artificial Sequence: Synthetic oligonucleotide
aggaggcauccaaaggcua

SEQ ID NO: 1835 - RNA, 19 nt, Artificial Sequence
  Description of Artificial Sequence: Synthetic oligonucleotide
caccgccuuugaguuggaa

SEQ ID NO: 1836 - RNA, 19 nt, Artificial Sequence
  Description of Artificial Sequence: Synthetic oligonucleotide
ccaacuauaaaacuaggua

SEQ ID NO: 1837 - RNA, 19 nt, Artificial Sequence
  Description of Artificial Sequence: Synthetic oligonucleotide
caagaagcaucgugucuga

SEQ ID NO: 1838 - RNA, 19 nt, Artificial Sequence
  Description of Artificial Sequence: Synthetic oligonucleotide
agcagcugaagaucuggaa

SEQ ID NO: 1839 - RNA, 19 nt, Artificial Sequence
  Description of Artificial Sequence: Synthetic oligonucleotide
gcgcucccuccugcuucua

SEQ ID NO: 1840 - RNA, 19 nt, Artificial Sequence
  Description of Artificial Sequence: Synthetic oligonucleotide
ugcuagucaacgccaugua

SEQ ID NO: 1841 - RNA, 19 nt, Artificial Sequence
  Description of Artificial Sequence: Synthetic oligonucleotide
cgccgagcagcugcgcgaa

SEQ ID NO: 1842 - RNA, 19 nt, Artificial Sequence
  Description of Artificial Sequence: Synthetic oligonucleotide
ccgcgcagaccaccgacga

SEQ ID NO: 1843 - RNA, 19 nt, Artificial Sequence
  Description of Artificial Sequence: Synthetic oligonucleotide
uagccagguaccuucucaa

SEQ ID NO: 1844 - RNA, 19 nt, Artificial Sequence
  Description of Artificial Sequence: Synthetic oligonucleotide
ugcuucucagcgccuucua

SEQ ID NO: 1845 - RNA, 19 nt, Artificial Sequence
  Description of Artificial Sequence: Synthetic oligonucleotide
cucccuccugcuucucaga

SEQ ID NO: 1846 - RNA, 19 nt, Artificial Sequence
  Description of Artificial Sequence: Synthetic oligonucleotide
cgcaggccaaggcagugca

SEQ ID NO: 1847 - RNA, 19 nt, Artificial Sequence
  Description of Artificial Sequence: Synthetic oligonucleotide
gcaaggcgaccacggcgua

SEQ ID NO: 1848 - RNA, 19 nt, Artificial Sequence
  Description of Artificial Sequence: Synthetic oligonucleotide
gcagccgcagcagcuccua

SEQ ID NO: 1849 - RNA, 19 nt, Artificial Sequence
  Description of Artificial Sequence: Synthetic oligonucleotide
uuugauagcaacaaaggcu

SEQ ID NO: 1850 - RNA, 19 nt, Artificial Sequence
  Description of Artificial Sequence: Synthetic oligonucleotide
uaucuugucacccuuaggc

SEQ ID NO: 1851 - RNA, 19 nt, Artificial Sequence
  Description of Artificial Sequence: Synthetic oligonucleotide
uucuugucacccuuaggcc

SEQ ID NO: 1852 - RNA, 19 nt, Artificial Sequence
  Description of Artificial Sequence: Synthetic oligonucleotide
uuaugaauacugauugagg

SEQ ID NO: 1853 - RNA, 19 nt, Artificial Sequence
  Description of Artificial Sequence: Synthetic oligonucleotide
ugcuccuucucaauccgcc

SEQ ID NO: 1854 - RNA, 19 nt, Artificial Sequence
  Description of Artificial Sequence: Synthetic oligonucleotide
uaggauguucuccacugcc

SEQ ID NO: 1855 - RNA, 19 nt, Artificial Sequence
  Description of Artificial Sequence: Synthetic oligonucleotide
uaagagggcuggcugaccc

SEQ ID NO: 1856 - RNA, 19 nt, Artificial Sequence
  Description of Artificial Sequence: Synthetic oligonucleotide
uucucgcaucuugucaccc

SEQ ID NO: 1857 - RNA, 19 nt, Artificial Sequence
  Description of Artificial Sequence: Synthetic oligonucleotide
uuucuccacugccuggucc

SEQ ID NO: 1858 - RNA, 19 nt, Artificial Sequence
  Description of Artificial Sequence: Synthetic oligonucleotide
uauagcacccaugugucuc

SEQ ID NO: 1859 - RNA, 19 nt, Artificial Sequence
  Description of Artificial Sequence: Synthetic oligonucleotide
uuuuuuuccacgcuccaac

SEQ ID NO: 1860 - RNA, 19 nt, Artificial Sequence
  Description of Artificial Sequence: Synthetic oligonucleotide
uaacaaaggcucauguucc

SEQ ID NO: 1861 - RNA, 19 nt, Artificial Sequence
  Description of Artificial Sequence: Synthetic oligonucleotide
uuggcuugaagaacauggc

SEQ ID NO: 1862 - RNA, 19 nt, Artificial Sequence
  Description of Artificial Sequence: Synthetic oligonucleotide
uggagcuccuucucaaucc

SEQ ID NO: 1863 - RNA, 19 nt, Artificial Sequence
  Description of Artificial Sequence: Synthetic oligonucleotide
uaaacaaaaaguucauccc

SEQ ID NO: 1864 - RNA, 19 nt, Artificial Sequence
  Description of Artificial Sequence: Synthetic oligonucleotide
uaauccgccucacugcggc

SEQ ID NO: 1865 - RNA, 19 nt, Artificial Sequence
  Description of Artificial Sequence: Synthetic oligonucleotide
uuucuagcugggaaggucc

SEQ ID NO: 1866 - RNA, 19 nt, Artificial Sequence
  Description of Artificial Sequence: Synthetic oligonucleotide
uauucuagcugggaagguc

SEQ ID NO: 1867 - RNA, 19 nt, Artificial Sequence
  Description of Artificial Sequence: Synthetic oligonucleotide
uucaauuuggucucacagg

SEQ ID NO: 1868 - RNA, 19 nt, Artificial Sequence
  Description of Artificial Sequence: Synthetic oligonucleotide
uacaccaggauguucucca

SEQ ID NO: 1869 - RNA, 19 nt, Artificial Sequence
  Description of Artificial Sequence: Synthetic oligonucleotide
uauugauagcaacaaaggc

SEQ ID NO: 1870 - RNA, 19 nt, Artificial Sequence
  Description of Artificial Sequence: Synthetic oligonucleotide
uuguccaacucaaaggcgg

SEQ ID NO: 1871 - RNA, 19 nt, Artificial Sequence
  Description of Artificial Sequence: Synthetic oligonucleotide
ugauguucuccacugccug

SEQ ID NO: 1872 - RNA, 19 nt, Artificial Sequence
  Description of Artificial Sequence: Synthetic oligonucleotide
uaauuuggucucacaggug

SEQ ID NO: 1873 - RNA, 19 nt, Artificial Sequence
  Description of Artificial Sequence: Synthetic oligonucleotide
ucuucuucugcaucuuccc

SEQ ID NO: 1874 - RNA, 19 nt, Artificial Sequence
  Description of Artificial Sequence: Synthetic oligonucleotide
uuuguucuugucaauggcc

SEQ ID NO: 1875 - RNA, 19 nt, Artificial Sequence
  Description of Artificial Sequence: Synthetic oligonucleotide
uuguguccaacucaaaggc

SEQ ID NO: 1876 - RNA, 19 nt, Artificial Sequence
  Description of Artificial Sequence: Synthetic oligonucleotide
uuagcugggaagguccgcu

SEQ ID NO: 1877 - RNA, 19 nt, Artificial Sequence
  Description of Artificial Sequence: Synthetic oligonucleotide
uauggcaacagccuucuuc

SEQ ID NO: 1878 - RNA, 19 nt, Artificial Sequence
  Description of Artificial Sequence: Synthetic oligonucleotide
uacucgucucgcaucuugu

SEQ ID NO: 1879 - RNA, 19 nt, Artificial Sequence
  Description of Artificial Sequence: Synthetic oligonucleotide
uuccuucucaauccgccuc

SEQ ID NO: 1880 - RNA, 19 nt, Artificial Sequence
  Description of Artificial Sequence: Synthetic oligonucleotide
uaugaagccacgguugucc

SEQ ID NO: 1881 - RNA, 19 nt, Artificial Sequence
  Description of Artificial Sequence: Synthetic oligonucleotide
uuaccuggcuauaaauaug

SEQ ID NO: 1882 - RNA, 19 nt, Artificial Sequence
  Description of Artificial Sequence: Synthetic oligonucleotide
uuuuuccuucucgucgucg

SEQ ID NO: 1883 - RNA, 19 nt, Artificial Sequence
  Description of Artificial Sequence: Synthetic oligonucleotide
uuuuggucucacaggugag

SEQ ID NO: 1884 - RNA, 19 nt, Artificial Sequence
  Description of Artificial Sequence: Synthetic oligonucleotide
uugaauagcagggagccgc

SEQ ID NO: 1885 - RNA, 19 nt, Artificial Sequence
  Description of Artificial Sequence: Synthetic oligonucleotide
ugugacaccaggauguucu

SEQ ID NO: 1886 - RNA, 19 nt, Artificial Sequence
  Description of Artificial Sequence: Synthetic oligonucleotide
uauuucucaucccagugug

SEQ ID NO: 1887 - RNA, 19 nt, Artificial Sequence
  Description of Artificial Sequence: Synthetic oligonucleotide
uaguggagugaauucuagc

SEQ ID NO: 1888 - RNA, 19 nt, Artificial Sequence
  Description of Artificial Sequence: Synthetic oligonucleotide
ugcacuaggaagaugaagg

SEQ ID NO: 1889 - RNA, 19 nt, Artificial Sequence
  Description of Artificial Sequence: Synthetic oligonucleotide
uguucuuggauugauagca

SEQ ID NO: 1890 - RNA, 19 nt, Artificial Sequence
  Description of Artificial Sequence: Synthetic oligonucleotide
uccuucuucugcaucuucc

SEQ ID NO: 1891 - RNA, 19 nt, Artificial Sequence
  Description of Artificial Sequence: Synthetic oligonucleotide
uuagcaacaaaggcucaug

SEQ ID NO: 1892 - RNA, 19 nt, Artificial Sequence
  Description of Artificial Sequence: Synthetic oligonucleotide
uagcuccuucucaauccgc

SEQ ID NO: 1893 - RNA, 19 nt, Artificial Sequence
  Description of Artificial Sequence: Synthetic oligonucleotide
uacucguugauggacugca

SEQ ID NO: 1894 - RNA, 19 nt, Artificial Sequence
  Description of Artificial Sequence: Synthetic oligonucleotide
uucaacuucuccgcagugc

SEQ ID NO: 1895 - RNA, 19 nt, Artificial Sequence
  Description of Artificial Sequence: Synthetic oligonucleotide
uauguucuccacugccugg

SEQ ID NO: 1896 - RNA, 19 nt, Artificial Sequence
  Description of Artificial Sequence: Synthetic oligonucleotide
uguacagguccuucuugcc

SEQ ID NO: 1897 - RNA, 19 nt, Artificial Sequence
  Description of Artificial Sequence: Synthetic oligonucleotide
ugucguaguaguuguagag

SEQ ID NO: 1898 - RNA, 19 nt, Artificial Sequence
  Description of Artificial Sequence: Synthetic oligonucleotide
uugaauucuagcugggaag

SEQ ID NO: 1899 - RNA, 19 nt, Artificial Sequence
  Description of Artificial Sequence: Synthetic oligonucleotide
ucuccuucucaauccgccu

SEQ ID NO: 1900 - RNA, 19 nt, Artificial Sequence
  Description of Artificial Sequence: Synthetic oligonucleotide
ucacccacgguauaggacc

SEQ ID NO: 1901 - RNA, 19 nt, Artificial Sequence
  Description of Artificial Sequence: Synthetic oligonucleotide
ugguacagguccuucuugc

SEQ ID NO: 1902 - RNA, 19 nt, Artificial Sequence
  Description of Artificial Sequence: Synthetic oligonucleotide
uucaucaugacacccacgg

SEQ ID NO: 1903 - RNA, 19 nt, Artificial Sequence
  Description of Artificial Sequence: Synthetic oligonucleotide
uuauaacucgucucgcauc

SEQ ID NO: 1904 - RNA, 19 nt, Artificial Sequence
  Description of Artificial Sequence: Synthetic oligonucleotide
uucggcgcucagcacugcc

SEQ ID NO: 1905 - RNA, 19 nt, Artificial Sequence
  Description of Artificial Sequence: Synthetic oligonucleotide
uuggagugaauucuagcug

SEQ ID NO: 1906 - RNA, 19 nt, Artificial Sequence
  Description of Artificial Sequence: Synthetic oligonucleotide
uaagucaucagcgaagcuc

SEQ ID NO: 1907 - RNA, 19 nt, Artificial Sequence
  Description of Artificial Sequence: Synthetic oligonucleotide
uucuguguccaacucaaag

SEQ ID NO: 1908 - RNA, 19 nt, Artificial Sequence
  Description of Artificial Sequence: Synthetic oligonucleotide
uaagccacgguuguccacc

SEQ ID NO: 1909 - RNA, 19 nt, Artificial Sequence
  Description of Artificial Sequence: Synthetic oligonucleotide
ugcaugaggaugaugaggc

SEQ ID NO: 1910 - RNA, 19 nt, Artificial Sequence
  Description of Artificial Sequence: Synthetic oligonucleotide
uuguucuccacugccuggu

SEQ ID NO: 1911 - RNA, 19 nt, Artificial Sequence
  Description of Artificial Sequence: Synthetic oligonucleotide
uaauacugauugaggcagg

SEQ ID NO: 1912 - RNA, 19 nt, Artificial Sequence
  Description of Artificial Sequence: Synthetic oligonucleotide
uauugaggcaggcuugauc

SEQ ID NO: 1913 - RNA, 19 nt, Artificial Sequence
  Description of Artificial Sequence: Synthetic oligonucleotide
ucuucuugaccagagucug

SEQ ID NO: 1914 - RNA, 19 nt, Artificial Sequence
  Description of Artificial Sequence: Synthetic oligonucleotide
uuugauggacugcagcgcg

SEQ ID NO: 1915 - RNA, 19 nt, Artificial Sequence
  Description of Artificial Sequence: Synthetic oligonucleotide
uacuucuccgcagugccag

SEQ ID NO: 1916 - RNA, 19 nt, Artificial Sequence
  Description of Artificial Sequence: Synthetic oligonucleotide
uagguugggauagagcugg

SEQ ID NO: 1917 - RNA, 19 nt, Artificial Sequence
  Description of Artificial Sequence: Synthetic oligonucleotide
uucaccuccaccacacccu

SEQ ID NO: 1918 - RNA, 19 nt, Artificial Sequence
  Description of Artificial Sequence: Synthetic oligonucleotide
uuucucaauccgccucacu

SEQ ID NO: 1919 - RNA, 19 nt, Artificial Sequence
  Description of Artificial Sequence: Synthetic oligonucleotide
uguuguagaggccuguccg

SEQ ID NO: 1920 - RNA, 19 nt, Artificial Sequence
  Description of Artificial Sequence: Synthetic oligonucleotide
uagcuuuuccuucucgucg

SEQ ID NO: 1921 - RNA, 19 nt, Artificial Sequence
  Description of Artificial Sequence: Synthetic oligonucleotide
uucagcacugccuuggccu

SEQ ID NO: 1922 - RNA, 19 nt, Artificial Sequence
  Description of Artificial Sequence: Synthetic oligonucleotide
ucugugugcacccugaggc

SEQ ID NO: 1923 - RNA, 19 nt, Artificial Sequence
  Description of Artificial Sequence: Synthetic oligonucleotide
uugguggaauuucucaucc

SEQ ID NO: 1924 - RNA, 19 nt, Artificial Sequence
  Description of Artificial Sequence: Synthetic oligonucleotide
uuuugcagcuuuuccuucu

SEQ ID NO: 1925 - RNA, 19 nt, Artificial Sequence
  Description of Artificial Sequence: Synthetic oligonucleotide
uagagguugggauagagcu

SEQ ID NO: 1926 - RNA, 19 nt, Artificial Sequence
  Description of Artificial Sequence: Synthetic oligonucleotide
uucgucucgcaucuuguca

SEQ ID NO: 1927 - RNA, 19 nt, Artificial Sequence
  Description of Artificial Sequence: Synthetic oligonucleotide
ucuccugggagcuccuucu

SEQ ID NO: 1928 - RNA, 19 nt, Artificial Sequence
  Description of Artificial Sequence: Synthetic oligonucleotide
ugucucacaggugagaagg

SEQ ID NO: 1929 - RNA, 19 nt, Artificial Sequence
  Description of Artificial Sequence: Synthetic oligonucleotide
uagagucugcccagaagcc

SEQ ID NO: 1930 - RNA, 19 nt, Artificial Sequence
  Description of Artificial Sequence: Synthetic oligonucleotide
uugaggaugaugaggcugg

SEQ ID NO: 1931 - RNA, 19 nt, Artificial Sequence
  Description of Artificial Sequence: Synthetic oligonucleotide
uugucucaggagccuuugg

SEQ ID NO: 1932 - RNA, 19 nt, Artificial Sequence
  Description of Artificial Sequence: Synthetic oligonucleotide
uugacuauggcccaggucc

SEQ ID NO: 1933 - RNA, 19 nt, Artificial Sequence
  Description of Artificial Sequence: Synthetic oligonucleotide
uugcaucaucaugacaccc

SEQ ID NO: 1934 - RNA, 19 nt, Artificial Sequence
  Description of Artificial Sequence: Synthetic oligonucleotide
uaguauccaaggcugguac

SEQ ID NO: 1935 - RNA, 19 nt, Artificial Sequence
  Description of Artificial Sequence: Synthetic oligonucleotide
uaaggagauggcaacagcc

SEQ ID NO: 1936 - RNA, 19 nt, Artificial Sequence
  Description of Artificial Sequence: Synthetic oligonucleotide
uucaauccgccucacugcg

SEQ ID NO: 1937 - RNA, 19 nt, Artificial Sequence
  Description of Artificial Sequence: Synthetic oligonucleotide
uugcgcuccacguccuugg

SEQ ID NO: 1938 - RNA, 19 nt, Artificial Sequence
  Description of Artificial Sequence: Synthetic oligonucleotide
uccaugugucucaggagcc

SEQ ID NO: 1939 - RNA, 19 nt, Artificial Sequence
  Description of Artificial Sequence: Synthetic oligonucleotide
uucguugauggacugcagc

SEQ ID NO: 1940 - RNA, 19 nt, Artificial Sequence
  Description of Artificial Sequence: Synthetic oligonucleotide
uaggugagaagguaccugg

SEQ ID NO: 1941 - RNA, 19 nt, Artificial Sequence
  Description of Artificial Sequence: Synthetic oligonucleotide
uuggacugcagcgcgcugc

SEQ ID NO: 1942 - RNA, 19 nt, Artificial Sequence
  Description of Artificial Sequence: Synthetic oligonucleotide
ucuagcucaauuuggucuc

SEQ ID NO: 1943 - RNA, 19 nt, Artificial Sequence
  Description of Artificial Sequence: Synthetic oligonucleotide
uuuucuucaccucggcggc

SEQ ID NO: 1944 - RNA, 19 nt, Artificial Sequence
  Description of Artificial Sequence: Synthetic oligonucleotide
uuucuugaccagagucugc

SEQ ID NO: 1945 - RNA, 19 nt, Artificial Sequence
  Description of Artificial Sequence: Synthetic oligonucleotide
uaaguggagugaauucuag

SEQ ID NO: 1946 - RNA, 19 nt, Artificial Sequence
  Description of Artificial Sequence: Synthetic oligonucleotide
ucaggauguucuccacugc

SEQ ID NO: 1947 - RNA, 19 nt, Artificial Sequence
  Description of Artificial Sequence: Synthetic oligonucleotide
ucuucuugccugacaugcg

SEQ ID NO: 1948 - RNA, 19 nt, Artificial Sequence
  Description of Artificial Sequence: Synthetic oligonucleotide
ugagcuccuucucaauccg

SEQ ID NO: 1949 - RNA, 19 nt, Artificial Sequence
  Description of Artificial Sequence: Synthetic oligonucleotide
uaaggcugguaccucaccu

SEQ ID NO: 1950 - RNA, 19 nt, Artificial Sequence
  Description of Artificial Sequence: Synthetic oligonucleotide
uuuucucaucccagugugg

SEQ ID NO: 1951 - RNA, 19 nt, Artificial Sequence
  Description of Artificial Sequence: Synthetic oligonucleotide
ucuuguucuugucaauggc

SEQ ID NO: 1952 - RNA, 19 nt, Artificial Sequence
  Description of Artificial Sequence: Synthetic oligonucleotide
uguugauggacugcagcgc

SEQ ID NO: 1953 - RNA, 19 nt, Artificial Sequence
  Description of Artificial Sequence: Synthetic oligonucleotide
uuaguuuuauaguugggag

SEQ ID NO: 1954 - RNA, 19 nt, Artificial Sequence
  Description of Artificial Sequence: Synthetic oligonucleotide
ugucucgcaucuugucacc

SEQ ID NO: 1955 - RNA, 19 nt, Artificial Sequence
  Description of Artificial Sequence: Synthetic oligonucleotide
uaugcgugacaagucggcc

SEQ ID NO: 1956 - RNA, 19 nt, Artificial Sequence
  Description of Artificial Sequence: Synthetic oligonucleotide
ucaucuugucacccuuagg

SEQ ID NO: 1957 - RNA, 19 nt, Artificial Sequence
  Description of Artificial Sequence: Synthetic oligonucleotide
uuagcacccaugugucuca

SEQ ID NO: 1958 - RNA, 19 nt, Artificial Sequence
  Description of Artificial Sequence: Synthetic oligonucleotide
ucggucuguuuuuccaccc

SEQ ID NO: 1959 - RNA, 19 nt, Artificial Sequence
  Description of Artificial Sequence: Synthetic oligonucleotide
uucaugggucaccuccacc

SEQ ID NO: 1960 - RNA, 19 nt, Artificial Sequence
  Description of Artificial Sequence: Synthetic oligonucleotide
uuagauguccuggucaaag

SEQ ID NO: 1961 - RNA, 19 nt, Artificial Sequence
  Description of Artificial Sequence: Synthetic oligonucleotide
ucaacaaaggcucauguuc

SEQ ID NO: 1962 - RNA, 19 nt, Artificial Sequence
  Description of Artificial Sequence: Synthetic oligonucleotide
ucauggaguauccaaggcu

SEQ ID NO: 1963 - RNA, 19 nt, Artificial Sequence
  Description of Artificial Sequence: Synthetic oligonucleotide
uaggucaugggucaccucc

SEQ ID NO: 1964 - RNA, 19 nt, Artificial Sequence
  Description of Artificial Sequence: Synthetic oligonucleotide
uuugaggcaggcuugaucu

SEQ ID NO: 1965 - RNA, 19 nt, Artificial Sequence
  Description of Artificial Sequence: Synthetic oligonucleotide
uuccaccacacccuugggc

SEQ ID NO: 1966 - RNA, 19 nt, Artificial Sequence
  Description of Artificial Sequence: Synthetic oligonucleotide
uacaagucggccuuguucu

SEQ ID NO: 1967 - RNA, 19 nt, Artificial Sequence
  Description of Artificial Sequence: Synthetic oligonucleotide
ugagucaccaugaagccac

SEQ ID NO: 1968 - RNA, 19 nt, Artificial Sequence
  Description of Artificial Sequence: Synthetic oligonucleotide
uacccaugugucucaggag

SEQ ID NO: 1969 - RNA, 19 nt, Artificial Sequence
  Description of Artificial Sequence: Synthetic oligonucleotide
uauggaguauccaaggcug

SEQ ID NO: 1970 - RNA, 19 nt, Artificial Sequence
  Description of Artificial Sequence: Synthetic oligonucleotide
uaugugucucaggagccuu

SEQ ID NO: 1971 - RNA, 19 nt, Artificial Sequence
  Description of Artificial Sequence: Synthetic oligonucleotide
uuggcaacagccuucuucu

SEQ ID NO: 1972 - RNA, 19 nt, Artificial Sequence
  Description of Artificial Sequence: Synthetic oligonucleotide
uuucucgucgucguaguag

SEQ ID NO: 1973 - RNA, 19 nt, Artificial Sequence
  Description of Artificial Sequence: Synthetic oligonucleotide
ugauugauagcaacaaagg

SEQ ID NO: 1974 - RNA, 19 nt, Artificial Sequence
  Description of Artificial Sequence: Synthetic oligonucleotide
uggauguucuccacugccu

SEQ ID NO: 1975 - RNA, 19 nt, Artificial Sequence
  Description of Artificial Sequence: Synthetic oligonucleotide
uagaggcuccacgugaugg

SEQ ID NO: 1976 - RNA, 19 nt, Artificial Sequence
  Description of Artificial Sequence: Synthetic oligonucleotide
uugaugaggcuggagagcu

SEQ ID NO: 1977 - RNA, 19 nt, Artificial Sequence
  Description of Artificial Sequence: Synthetic oligonucleotide
uaaugaauagcagggagcc

SEQ ID NO: 1978 - RNA, 19 nt, Artificial Sequence
  Description of Artificial Sequence: Synthetic oligonucleotide
uacaaaggcucauguuccc

SEQ ID NO: 1979 - RNA, 19 nt, Artificial Sequence
  Description of Artificial Sequence: Synthetic oligonucleotide
ugcagaaugacuauggccc

SEQ ID NO: 1980 - RNA, 19 nt, Artificial Sequence
  Description of Artificial Sequence: Synthetic oligonucleotide
uucuucagcugcucuuugg

SEQ ID NO: 1981 - RNA, 19 nt, Artificial Sequence
  Description of Artificial Sequence: Synthetic oligonucleotide
ucagcuuuuccuucucguc

SEQ ID NO: 1982 - RNA, 19 nt, Artificial Sequence
  Description of Artificial Sequence: Synthetic oligonucleotide
ugagucugcccagaagccc

SEQ ID NO: 1983 - RNA, 19 nt, Artificial Sequence
  Description of Artificial Sequence: Synthetic oligonucleotide
uuccacugccugguccuug

SEQ ID NO: 1984 - RNA, 19 nt, Artificial Sequence
  Description of Artificial Sequence: Synthetic oligonucleotide
ucucaauuuggucucacag

SEQ ID NO: 1985 - RNA, 19 nt, Artificial Sequence
  Description of Artificial Sequence: Synthetic oligonucleotide
uuugucaauggccucaguc

SEQ ID NO: 1986 - RNA, 19 nt, Artificial Sequence
  Description of Artificial Sequence: Synthetic oligonucleotide
uugacaugcgugacaaguc

SEQ ID NO: 1987 - RNA, 19 nt, Artificial Sequence
  Description of Artificial Sequence: Synthetic oligonucleotide
uaggcugguaccucaccuc

SEQ ID NO: 1988 - RNA, 19 nt, Artificial Sequence
  Description of Artificial Sequence: Synthetic oligonucleotide
uucagcaucaugguaucug

SEQ ID NO: 1989 - RNA, 19 nt, Artificial Sequence
  Description of Artificial Sequence: Synthetic oligonucleotide
uuacagguccuucuugccu

SEQ ID NO: 1990 - RNA, 19 nt, Artificial Sequence
  Description of Artificial Sequence: Synthetic oligonucleotide
uuggaauuucucaucccag

SEQ ID NO: 1991 - RNA, 19 nt, Artificial Sequence
  Description of Artificial Sequence: Synthetic oligonucleotide
uuauccaaggcugguaccu

SEQ ID NO: 1992 - RNA, 19 nt, Artificial Sequence
  Description of Artificial Sequence: Synthetic oligonucleotide
uucagaagagggcuggcug

SEQ ID NO: 1993 - RNA, 19 nt, Artificial Sequence
  Description of Artificial Sequence: Synthetic oligonucleotide
uggugcaucaucaugacac

SEQ ID NO: 1994 - RNA, 19 nt, Artificial Sequence
  Description of Artificial Sequence: Synthetic oligonucleotide
uucguaguaguuguagagg

SEQ ID NO: 1995 - RNA, 19 nt, Artificial Sequence
  Description of Artificial Sequence: Synthetic oligonucleotide
uguuucuucaccucggcgg

SEQ ID NO: 1996 - RNA, 19 nt, Artificial Sequence
  Description of Artificial Sequence: Synthetic oligonucleotide
uaguucuuggauugauagc

SEQ ID NO: 1997 - RNA, 19 nt, Artificial Sequence
  Description of Artificial Sequence: Synthetic oligonucleotide
uuacugauugaggcaggcu

SEQ ID NO: 1998 - RNA, 19 nt, Artificial Sequence
  Description of Artificial Sequence: Synthetic oligonucleotide
uucacccuuaggccggacc

SEQ ID NO: 1999 - RNA, 19 nt, Artificial Sequence
  Description of Artificial Sequence: Synthetic oligonucleotide
uauuugcagcuuuuccuuc

SEQ ID NO: 2000 - RNA, 19 nt, Artificial Sequence
  Description of Artificial Sequence: Synthetic oligonucleotide
uguaguaguuguagaggcc

SEQ ID NO: 2001 - RNA, 19 nt, Artificial Sequence
  Description of Artificial Sequence: Synthetic oligonucleotide
uaguguggcuugaagaaca

SEQ ID NO: 2002 - RNA, 19 nt, Artificial Sequence
  Description of Artificial Sequence: Synthetic oligonucleotide
ucucagcacugccuuggcc

SEQ ID NO: 2003 - RNA, 19 nt, Artificial Sequence
  Description of Artificial Sequence: Synthetic oligonucleotide
uucuugugguggaauuucu

SEQ ID NO: 2004 - RNA, 19 nt, Artificial Sequence
  Description of Artificial Sequence: Synthetic oligonucleotide
ucucguugauggacugcag

SEQ ID NO: 2005 - RNA, 19 nt, Artificial Sequence
  Description of Artificial Sequence: Synthetic oligonucleotide
uuggcguggaacacgcugg

SEQ ID NO: 2006 - RNA, 19 nt, Artificial Sequence
  Description of Artificial Sequence: Synthetic oligonucleotide
uugagaagcaggagggagc

SEQ ID NO: 2007 - RNA, 19 nt, Artificial Sequence
  Description of Artificial Sequence: Synthetic oligonucleotide
uuuguagaggccuguccgg

SEQ ID NO: 2008 - RNA, 19 nt, Artificial Sequence
  Description of Artificial Sequence: Synthetic oligonucleotide
ugaggcuccacgugauggg

SEQ ID NO: 2009 - RNA, 19 nt, Artificial Sequence
  Description of Artificial Sequence: Synthetic oligonucleotide
uuugucacccuuaggccgg

SEQ ID NO: 2010 - RNA, 19 nt, Artificial Sequence
  Description of Artificial Sequence: Synthetic oligonucleotide
uugacacccacgguauagg

SEQ ID NO: 2011 - RNA, 19 nt, Artificial Sequence
  Description of Artificial Sequence: Synthetic oligonucleotide
uccaggauguucuccacug

SEQ ID NO: 2012 - RNA, 19 nt, Artificial Sequence
  Description of Artificial Sequence: Synthetic oligonucleotide
ugaauuucucaucccagug

SEQ ID NO: 2013 - RNA, 19 nt, Artificial Sequence
  Description of Artificial Sequence: Synthetic oligonucleotide
uucucaggagccuuuggau

SEQ ID NO: 2014 - RNA, 19 nt, Artificial Sequence
  Description of Artificial Sequence: Synthetic oligonucleotide
uuugugguggaauuucuca

SEQ ID NO: 2015 - RNA, 19 nt, Artificial Sequence
  Description of Artificial Sequence: Synthetic oligonucleotide
uccggucuguuuuuccacc

SEQ ID NO: 2016 - RNA, 19 nt, Artificial Sequence
  Description of Artificial Sequence: Synthetic oligonucleotide
uuacagucggcugcccagc

SEQ ID NO: 2017 - RNA, 19 nt, Artificial Sequence
  Description of Artificial Sequence: Synthetic oligonucleotide
ucaggcagaaugacuaugg

SEQ ID NO: 2018 - RNA, 19 nt, Artificial Sequence
  Description of Artificial Sequence: Synthetic oligonucleotide
uuagaggccuguccggugc

SEQ ID NO: 2019 - RNA, 19 nt, Artificial Sequence
  Description of Artificial Sequence: Synthetic oligonucleotide
uuugccaucuguguccaac

SEQ ID NO: 2020 - RNA, 19 nt, Artificial Sequence
  Description of Artificial Sequence: Synthetic oligonucleotide
uauacugauugaggcaggc

SEQ ID NO: 2021 - RNA, 19 nt, Artificial Sequence
  Description of Artificial Sequence: Synthetic oligonucleotide
uuugucgcggaaguugauc

SEQ ID NO: 2022 - RNA, 19 nt, Artificial Sequence
  Description of Artificial Sequence: Synthetic oligonucleotide
uauccgccucacugcggcc

SEQ ID NO: 2023 - RNA, 19 nt, Artificial Sequence
  Description of Artificial Sequence: Synthetic oligonucleotide
uggcucaacuucuccgcag

SEQ ID NO: 2024 - RNA, 19 nt, Artificial Sequence
  Description of Artificial Sequence: Synthetic oligonucleotide
uucaggagccuuuggaugc

SEQ ID NO: 2025 - RNA, 19 nt, Artificial Sequence
  Description of Artificial Sequence: Synthetic oligonucleotide
ucagagucugcccagaagc

SEQ ID NO: 2026 - RNA, 19 nt, Artificial Sequence
  Description of Artificial Sequence: Synthetic oligonucleotide
ugugucagaagagggcugg

SEQ ID NO: 2027 - RNA, 19 nt, Artificial Sequence
  Description of Artificial Sequence: Synthetic oligonucleotide
ugagagguugggauagagc

SEQ ID NO: 2028 - RNA, 19 nt, Artificial Sequence
  Description of Artificial Sequence: Synthetic oligonucleotide
uuccgugcgcuccacgucc

SEQ ID NO: 2029 - RNA, 19 nt, Artificial Sequence
  Description of Artificial Sequence: Synthetic oligonucleotide
ucgcucagcacugccuugg

SEQ ID NO: 2030 - RNA, 19 nt, Artificial Sequence
  Description of Artificial Sequence: Synthetic oligonucleotide
ugcaacagccuucuucugc

SEQ ID NO: 2031 - RNA, 19 nt, Artificial Sequence
  Description of Artificial Sequence: Synthetic oligonucleotide
uacgcuccaacaaaauguc

SEQ ID NO: 2032 - RNA, 19 nt, Artificial Sequence
  Description of Artificial Sequence: Synthetic oligonucleotide
uuugaucuuggagugcucg

SEQ ID NO: 2033 - RNA, 19 nt, Artificial Sequence
  Description of Artificial Sequence: Synthetic oligonucleotide
uuccggugcaucaucauga

SEQ ID NO: 2034 - RNA, 19 nt, Artificial Sequence
  Description of Artificial Sequence: Synthetic oligonucleotide
uaaggcgcugagaagcagg

SEQ ID NO: 2035 - RNA, 19 nt, Artificial Sequence
  Description of Artificial Sequence: Synthetic oligonucleotide
uuaguugggagagguuggg

SEQ ID NO: 2036 - RNA, 19 nt, Artificial Sequence
  Description of Artificial Sequence: Synthetic oligonucleotide
uuugaccagagucugccca

SEQ ID NO: 2037 - RNA, 19 nt, Artificial Sequence
  Description of Artificial Sequence: Synthetic oligonucleotide
ugaugcuucuugaccagag

SEQ ID NO: 2038 - RNA, 19 nt, Artificial Sequence
  Description of Artificial Sequence: Synthetic oligonucleotide
uaaggcgcucgagaggcuc

SEQ ID NO: 2039 - RNA, 19 nt, Artificial Sequence
  Description of Artificial Sequence: Synthetic oligonucleotide
uagauggcaacagccuucu

SEQ ID NO: 2040 - RNA, 19 nt, Artificial Sequence
  Description of Artificial Sequence: Synthetic oligonucleotide
uuggcguugacuagcaggg

SEQ ID NO: 2041 - RNA, 19 nt, Artificial Sequence
  Description of Artificial Sequence: Synthetic oligonucleotide
ucugguacaagcugaaggc

SEQ ID NO: 2042 - RNA, 19 nt, Artificial Sequence
  Description of Artificial Sequence: Synthetic oligonucleotide
uugcucuuugguuagcagc

SEQ ID NO: 2043 - RNA, 19 nt, Artificial Sequence
  Description of Artificial Sequence: Synthetic oligonucleotide
uggcuggagagcuuguggg

SEQ ID NO: 2044 - RNA, 19 nt, Artificial Sequence
  Description of Artificial Sequence: Synthetic oligonucleotide
ucaaugaauagcagggagc

SEQ ID NO: 2045 - RNA, 19 nt, Artificial Sequence
  Description of Artificial Sequence: Synthetic oligonucleotide
uucccuaucuuugaagaac

SEQ ID NO: 2046 - RNA, 19 nt, Artificial Sequence
  Description of Artificial Sequence: Synthetic oligonucleotide
uagaagagggcuggcugac

SEQ ID NO: 2047 - RNA, 19 nt, Artificial Sequence
  Description of Artificial Sequence: Synthetic oligonucleotide
uccgcuuugggugucccgc

SEQ ID NO: 2048 - RNA, 19 nt, Artificial Sequence
  Description of Artificial Sequence: Synthetic oligonucleotide
uacugcagcgcgcugcgcu

SEQ ID NO: 2049 - RNA, 19 nt, Artificial Sequence
  Description of Artificial Sequence: Synthetic oligonucleotide
uaggauguggaguuuccgg

SEQ ID NO: 2050 - RNA, 19 nt, Artificial Sequence
  Description of Artificial Sequence: Synthetic oligonucleotide
uccuuguucuugucaaugg

SEQ ID NO: 2051 - RNA, 19 nt, Artificial Sequence
  Description of Artificial Sequence: Synthetic oligonucleotide
uucgcgcccguagaugucc

SEQ ID NO: 2052 - RNA, 19 nt, Artificial Sequence
  Description of Artificial Sequence: Synthetic oligonucleotide
ucaauagcacccauguguc

SEQ ID NO: 2053 - RNA, 19 nt, Artificial Sequence
  Description of Artificial Sequence: Synthetic oligonucleotide
ucuucuccgcagugccagg

SEQ ID NO: 2054 - RNA, 19 nt, Artificial Sequence
  Description of Artificial Sequence: Synthetic oligonucleotide
uauggccucagucaggccc

SEQ ID NO: 2055 - RNA, 19 nt, Artificial Sequence
  Description of Artificial Sequence: Synthetic oligonucleotide
uaauuucucaucccagugu

SEQ ID NO: 2056 - RNA, 19 nt, Artificial Sequence
  Description of Artificial Sequence: Synthetic oligonucleotide
ugaagagggcuggcugacc

SEQ ID NO: 2057 - RNA, 19 nt, Artificial Sequence
  Description of Artificial Sequence: Synthetic oligonucleotide
ucuucucaauccgccucac

SEQ ID NO: 2058 - RNA, 19 nt, Artificial Sequence
  Description of Artificial Sequence: Synthetic oligonucleotide
uauuuggucucacagguga

SEQ ID NO: 2059 - RNA, 19 nt, Artificial Sequence
  Description of Artificial Sequence: Synthetic oligonucleotide
uucuccacgauuugcagcu

SEQ ID NO: 2060 - RNA, 19 nt, Artificial Sequence
  Description of Artificial Sequence: Synthetic oligonucleotide
uugccauccugugugcacc

SEQ ID NO: 2061 - RNA, 19 nt, Artificial Sequence
  Description of Artificial Sequence: Synthetic oligonucleotide
ugucaccuccaccacaccc

SEQ ID NO: 2062 - RNA, 19 nt, Artificial Sequence
  Description of Artificial Sequence: Synthetic oligonucleotide
uuggaguauccaaggcugg

SEQ ID NO: 2063 - RNA, 19 nt, Artificial Sequence
  Description of Artificial Sequence: Synthetic oligonucleotide
uaggcuggagagcuugugg

SEQ ID NO: 2064 - RNA, 19 nt, Artificial Sequence
  Description of Artificial Sequence: Synthetic oligonucleotide
uugugucucaggagccuuu

SEQ ID NO: 2065 - RNA, 19 nt, Artificial Sequence
  Description of Artificial Sequence: Synthetic oligonucleotide
ucgauuugcagcuuuuccu

SEQ ID NO: 2066 - RNA, 19 nt, Artificial Sequence
  Description of Artificial Sequence: Synthetic oligonucleotide
ugugccaggagcugcugcg

SEQ ID NO: 2067 - RNA, 19 nt, Artificial Sequence
  Description of Artificial Sequence: Synthetic oligonucleotide
ugugcaucaucaugacacc

SEQ ID NO: 2068 - RNA, 19 nt, Artificial Sequence
  Description of Artificial Sequence: Synthetic oligonucleotide
uuuuuagugucagaagagg

SEQ ID NO: 2069 - RNA, 19 nt, Artificial Sequence
  Description of Artificial Sequence: Synthetic oligonucleotide
uguggagugaauucuagcu

SEQ ID NO: 2070 - RNA, 19 nt, Artificial Sequence
  Description of Artificial Sequence: Synthetic oligonucleotide
uucgccuugccgcccagcg

SEQ ID NO: 2071 - RNA, 19 nt, Artificial Sequence
  Description of Artificial Sequence: Synthetic oligonucleotide
ucaagcugaaggccaggcc

SEQ ID NO: 2072 - RNA, 19 nt, Artificial Sequence
  Description of Artificial Sequence: Synthetic oligonucleotide
uaauagcacccaugugucu

SEQ ID NO: 2073 - RNA, 19 nt, Artificial Sequence
  Description of Artificial Sequence: Synthetic oligonucleotide
uaucaucaugacacccacg

SEQ ID NO: 2074 - RNA, 19 nt, Artificial Sequence
  Description of Artificial Sequence: Synthetic oligonucleotide
ucaucaucaugacacccac

SEQ ID NO: 2075 - RNA, 19 nt, Artificial Sequence
  Description of Artificial Sequence: Synthetic oligonucleotide
uuccugggagcuccuucuc

SEQ ID NO: 2076 - RNA, 19 nt, Artificial Sequence
  Description of Artificial Sequence: Synthetic oligonucleotide
uugcuucuugaccagaguc

SEQ ID NO: 2077 - RNA, 19 nt, Artificial Sequence
  Description of Artificial Sequence: Synthetic oligonucleotide
uagcugagguguuuuagug

SEQ ID NO: 2078 - RNA, 19 nt, Artificial Sequence
  Description of Artificial Sequence: Synthetic oligonucleotide
ugagccuuuggaugccucc

SEQ ID NO: 2079 - RNA, 19 nt, Artificial Sequence
  Description of Artificial Sequence: Synthetic oligonucleotide
uagcucacugagcuggguc

SEQ ID NO: 2080 - RNA, 19 nt, Artificial Sequence
  Description of Artificial Sequence: Synthetic oligonucleotide
uuguuucugcaggucaugg

SEQ ID NO: 2081 - RNA, 19 nt, Artificial Sequence
  Description of Artificial Sequence: Synthetic oligonucleotide
ucagccuucuucugcaucu

SEQ ID NO: 2082 - RNA, 19 nt, Artificial Sequence
  Description of Artificial Sequence: Synthetic oligonucleotide
uuuguagugcugcuugcug

SEQ ID NO: 2083 - RNA, 19 nt, Artificial Sequence
  Description of Artificial Sequence: Synthetic oligonucleotide
uaugaggcuggagagcuug

SEQ ID NO: 2084 - RNA, 19 nt, Artificial Sequence
  Description of Artificial Sequence: Synthetic oligonucleotide
ucaacagccuucuucugca

SEQ ID NO: 2085 - RNA, 19 nt, Artificial Sequence
  Description of Artificial Sequence: Synthetic oligonucleotide
uugcgcagcuccucgcgcc

SEQ ID NO: 2086 - RNA, 19 nt, Artificial Sequence
  Description of Artificial Sequence: Synthetic oligonucleotide
uguauccaaggcugguacc

SEQ ID NO: 2087 - RNA, 19 nt, Artificial Sequence
  Description of Artificial Sequence: Synthetic oligonucleotide
uguccguacagucggcugc

SEQ ID NO: 2088 - RNA, 19 nt, Artificial Sequence
  Description of Artificial Sequence: Synthetic oligonucleotide
uaugaggaugaugaggcug

SEQ ID NO: 2089 - RNA, 19 nt, Artificial Sequence
  Description of Artificial Sequence: Synthetic oligonucleotide
ucaacucaaaggcgguggc

SEQ ID NO: 2090 - RNA, 19 nt, Artificial Sequence
  Description of Artificial Sequence: Synthetic oligonucleotide
uccagguacagguccuucu

SEQ ID NO: 2091 - RNA, 19 nt, Artificial Sequence
  Description of Artificial Sequence: Synthetic oligonucleotide
ugcugcagguuucuucacc

SEQ ID NO: 2092 - RNA, 19 nt, Artificial Sequence
  Description of Artificial Sequence: Synthetic oligonucleotide
uucacaggugagaagguac

SEQ ID NO: 2093 - RNA, 19 nt, Artificial Sequence
  Description of Artificial Sequence: Synthetic oligonucleotide
uacugccugguccuuggcc

SEQ ID NO: 2094 - RNA, 19 nt, Artificial Sequence
  Description of Artificial Sequence: Synthetic oligonucleotide
ucguggucgccuugccgcc

SEQ ID NO: 2095 - RNA, 19 nt, Artificial Sequence
  Description of Artificial Sequence: Synthetic oligonucleotide
uaguugaucuuggagugcu

SEQ ID NO: 2096 - RNA, 19 nt, Artificial Sequence
  Description of Artificial Sequence: Synthetic oligonucleotide
uguaccuggcuauaaauau

SEQ ID NO: 2097 - RNA, 19 nt, Artificial Sequence
  Description of Artificial Sequence: Synthetic oligonucleotide
uuccguacagucggcugcc

SEQ ID NO: 2098 - RNA, 19 nt, Artificial Sequence
  Description of Artificial Sequence: Synthetic oligonucleotide
uuugccugacaugcgugac

SEQ ID NO: 2099 - RNA, 19 nt, Artificial Sequence
  Description of Artificial Sequence: Synthetic oligonucleotide
uuaguuguagaggccuguc

SEQ ID NO: 2100 - RNA, 19 nt, Artificial Sequence
  Description of Artificial Sequence: Synthetic oligonucleotide
uacagccuucuucugcauc

SEQ ID NO: 2101 - RNA, 19 nt, Artificial Sequence
  Description of Artificial Sequence: Synthetic oligonucleotide
uuuucugcaggucaugggu

SEQ ID NO: 2102 - RNA, 19 nt, Artificial Sequence
  Description of Artificial Sequence: Synthetic oligonucleotide
uccgagucaccaugaagcc

SEQ ID NO: 2103 - RNA, 19 nt, Artificial Sequence
  Description of Artificial Sequence: Synthetic oligonucleotide
uugaauacugauugaggca

SEQ ID NO: 2104 - RNA, 19 nt, Artificial Sequence
  Description of Artificial Sequence: Synthetic oligonucleotide
ucaguguggcuugaagaac

SEQ ID NO: 2105 - RNA, 19 nt, Artificial Sequence
  Description of Artificial Sequence: Synthetic oligonucleotide
uggaaguugaucuuggagu

SEQ ID NO: 2106 - RNA, 19 nt, Artificial Sequence
  Description of Artificial Sequence: Synthetic oligonucleotide
uuggucggcguagaacagc

SEQ ID NO: 2107 - RNA, 19 nt, Artificial Sequence
  Description of Artificial Sequence: Synthetic oligonucleotide
uagaacauggcguugacua

SEQ ID NO: 2108 - RNA, 19 nt, Artificial Sequence
  Description of Artificial Sequence: Synthetic oligonucleotide
uguccgcucaggcacacgg

SEQ ID NO: 2109 - RNA, 19 nt, Artificial Sequence
  Description of Artificial Sequence: Synthetic oligonucleotide
uuaguaguuguagaggccu

SEQ ID NO: 2110 - RNA, 19 nt, Artificial Sequence
  Description of Artificial Sequence: Synthetic oligonucleotide
uaccgagucaccaugaagc

SEQ ID NO: 2111 - RNA, 19 nt, Artificial Sequence
  Description of Artificial Sequence: Synthetic oligonucleotide
uacacgaugcuucuugacc

SEQ ID NO: 2112 - RNA, 19 nt, Artificial Sequence
  Description of Artificial Sequence: Synthetic oligonucleotide
uaucuuggagugcucgcag

SEQ ID NO: 2113 - RNA, 19 nt, Artificial Sequence
  Description of Artificial Sequence: Synthetic oligonucleotide
uacacccacgguauaggac

SEQ ID NO: 2114 - RNA, 19 nt, Artificial Sequence
  Description of Artificial Sequence: Synthetic oligonucleotide
uaauggccucagucaggcc

SEQ ID NO: 2115 - RNA, 19 nt, Artificial Sequence
  Description of Artificial Sequence: Synthetic oligonucleotide
ugaaguugaucuuggagug

SEQ ID NO: 2116 - RNA, 19 nt, Artificial Sequence
  Description of Artificial Sequence: Synthetic oligonucleotide
uugccuuggccugcgacgc

SEQ ID NO: 2117 - RNA, 19 nt, Artificial Sequence
  Description of Artificial Sequence: Synthetic oligonucleotide
uucgcaucuugucacccuu

SEQ ID NO: 2118 - RNA, 19 nt, Artificial Sequence
  Description of Artificial Sequence: Synthetic oligonucleotide
uucggcguagaacagcuug

SEQ ID NO: 2119 - RNA, 19 nt, Artificial Sequence
  Description of Artificial Sequence: Synthetic oligonucleotide
uauggcguugacuagcagg

SEQ ID NO: 2120 - RNA, 19 nt, Artificial Sequence
  Description of Artificial Sequence: Synthetic oligonucleotide
uccuccaccacacccuugg

SEQ ID NO: 2121 - RNA, 19 nt, Artificial Sequence
  Description of Artificial Sequence: Synthetic oligonucleotide
ucuccugccauccugugug

SEQ ID NO: 2122 - RNA, 19 nt, Artificial Sequence
  Description of Artificial Sequence: Synthetic oligonucleotide
ucacccaugugucucagga

SEQ ID NO: 2123 - RNA, 19 nt, Artificial Sequence
  Description of Artificial Sequence: Synthetic oligonucleotide
uucgucguaguaguuguag

SEQ ID NO: 2124 - RNA, 19 nt, Artificial Sequence
  Description of Artificial Sequence: Synthetic oligonucleotide
ucucgucucgcaucuuguc

SEQ ID NO: 2125 - RNA, 19 nt, Artificial Sequence
  Description of Artificial Sequence: Synthetic oligonucleotide
uggcugcccagcuuccagg

SEQ ID NO: 2126 - RNA, 19 nt, Artificial Sequence
  Description of Artificial Sequence: Synthetic oligonucleotide
uucccaguguggcuugaag

SEQ ID NO: 2127 - RNA, 19 nt, Artificial Sequence
  Description of Artificial Sequence: Synthetic oligonucleotide
ucccuauaacucgucucgc

SEQ ID NO: 2128 - RNA, 19 nt, Artificial Sequence
  Description of Artificial Sequence: Synthetic oligonucleotide
uagucggcugcccagcuuc

SEQ ID NO: 2129 - RNA, 19 nt, Artificial Sequence
  Description of Artificial Sequence: Synthetic oligonucleotide
ugaagguccgcucaggcac

SEQ ID NO: 2130 - RNA, 19 nt, Artificial Sequence
  Description of Artificial Sequence: Synthetic oligonucleotide
uugcaggucaugggucacc

SEQ ID NO: 2131 - RNA, 19 nt, Artificial Sequence
  Description of Artificial Sequence: Synthetic oligonucleotide
uauagcaacaaaggcucau

SEQ ID NO: 2132 - RNA, 19 nt, Artificial Sequence
  Description of Artificial Sequence: Synthetic oligonucleotide
uucgucgucguaguaguug

SEQ ID NO: 2133 - RNA, 19 nt, Artificial Sequence
  Description of Artificial Sequence: Synthetic oligonucleotide
uuugcugagugagcgcagc

SEQ ID NO: 2134 - RNA, 19 nt, Artificial Sequence
  Description of Artificial Sequence: Synthetic oligonucleotide
uugacaccaggauguucuc

SEQ ID NO: 2135 - RNA, 19 nt, Artificial Sequence
  Description of Artificial Sequence: Synthetic oligonucleotide
uggcguagaacagcuuggg

SEQ ID NO: 2136 - RNA, 19 nt, Artificial Sequence
  Description of Artificial Sequence: Synthetic oligonucleotide
ugagguugggauagagcug

SEQ ID NO: 2137 - RNA, 19 nt, Artificial Sequence
  Description of Artificial Sequence: Synthetic oligonucleotide
uagucaucagcgaagcuca

SEQ ID NO: 2138 - RNA, 19 nt, Artificial Sequence
  Description of Artificial Sequence: Synthetic oligonucleotide
uaagcguggccgccuuggg

SEQ ID NO: 2139 - RNA, 19 nt, Artificial Sequence
  Description of Artificial Sequence: Synthetic oligonucleotide
uaugacacccacgguauag

SEQ ID NO: 2140 - RNA, 19 nt, Artificial Sequence
  Description of Artificial Sequence: Synthetic oligonucleotide
ugccuuguucuugucaaug

SEQ ID NO: 2141 - RNA, 19 nt, Artificial Sequence
  Description of Artificial Sequence: Synthetic oligonucleotide
ugcucacugagcugggucc

SEQ ID NO: 2142 - RNA, 19 nt, Artificial Sequence
  Description of Artificial Sequence: Synthetic oligonucleotide
ucuuuuccuucucgucguc

SEQ ID NO: 2143 - RNA, 19 nt, Artificial Sequence
  Description of Artificial Sequence: Synthetic oligonucleotide
uccguggucgccuugccgc

SEQ ID NO: 2144 - RNA, 19 nt, Artificial Sequence
  Description of Artificial Sequence: Synthetic oligonucleotide
uagccgcuuuggguguccc

SEQ ID NO: 2145 - RNA, 19 nt, Artificial Sequence
  Description of Artificial Sequence: Synthetic oligonucleotide
ugcugguaccucaccuccc

SEQ ID NO: 2146 - RNA, 19 nt, Artificial Sequence
  Description of Artificial Sequence: Synthetic oligonucleotide
uucgcaguuguagugcugc

SEQ ID NO: 2147 - RNA, 19 nt, Artificial Sequence
  Description of Artificial Sequence: Synthetic oligonucleotide
uuuccaggucacguugcgc

SEQ ID NO: 2148 - RNA, 19 nt, Artificial Sequence
  Description of Artificial Sequence: Synthetic oligonucleotide
ucucagucaggcccagccc

SEQ ID NO: 2149 - RNA, 19 nt, Artificial Sequence
  Description of Artificial Sequence: Synthetic oligonucleotide
uugggaagguccgcucagg

SEQ ID NO: 2150 - RNA, 19 nt, Artificial Sequence
  Description of Artificial Sequence: Synthetic oligonucleotide
uauccagaucuucagcugc

SEQ ID NO: 2151 - RNA, 19 nt, Artificial Sequence
  Description of Artificial Sequence: Synthetic oligonucleotide
uaccaggauguucuccacu

SEQ ID NO: 2152 - RNA, 19 nt, Artificial Sequence
  Description of Artificial Sequence: Synthetic oligonucleotide
uaguuguagugcugcuugc

SEQ ID NO: 2153 - RNA, 19 nt, Artificial Sequence
  Description of Artificial Sequence: Synthetic oligonucleotide
uagcgaagcucacugagcu

SEQ ID NO: 2154 - RNA, 19 nt, Artificial Sequence
  Description of Artificial Sequence: Synthetic oligonucleotide
uacaugcgugacaagucgg

SEQ ID NO: 2155 - RNA, 19 nt, Artificial Sequence
  Description of Artificial Sequence: Synthetic oligonucleotide
ucguccuuggugaccucgg

SEQ ID NO: 2156 - RNA, 19 nt, Artificial Sequence
  Description of Artificial Sequence: Synthetic oligonucleotide
uaggcgcucgagaggcucc

SEQ ID NO: 2157 - RNA, 19 nt, Artificial Sequence
  Description of Artificial Sequence: Synthetic oligonucleotide
uucgguggucugcgcggcc

SEQ ID NO: 2158 - RNA, 19 nt, Artificial Sequence
  Description of Artificial Sequence: Synthetic oligonucleotide
uacaggauguggaguuucc

SEQ ID NO: 2159 - RNA, 19 nt, Artificial Sequence
  Description of Artificial Sequence: Synthetic oligonucleotide
uuagcagggagccgcuuug

SEQ ID NO: 2160 - RNA, 19 nt, Artificial Sequence
  Description of Artificial Sequence: Synthetic oligonucleotide
ucccaugugucucaggagc

SEQ ID NO: 2161 - RNA, 19 nt, Artificial Sequence
  Description of Artificial Sequence: Synthetic oligonucleotide
ugaaugacuauggcccagg

SEQ ID NO: 2162 - RNA, 19 nt, Artificial Sequence
  Description of Artificial Sequence: Synthetic oligonucleotide
ucgcucgagaggcuccacg

SEQ ID NO: 2163 - RNA, 19 nt, Artificial Sequence
  Description of Artificial Sequence: Synthetic oligonucleotide
ugcgcugagaagcaggagg

SEQ ID NO: 2164 - RNA, 19 nt, Artificial Sequence
  Description of Artificial Sequence: Synthetic oligonucleotide
ucaggcuugaucugggacu

SEQ ID NO: 2165 - RNA, 19 nt, Artificial Sequence
  Description of Artificial Sequence: Synthetic oligonucleotide
uaucaugacacccacggua

SEQ ID NO: 2166 - RNA, 19 nt, Artificial Sequence
  Description of Artificial Sequence: Synthetic oligonucleotide
uugucagaagagggcuggc

SEQ ID NO: 2167 - RNA, 19 nt, Artificial Sequence
  Description of Artificial Sequence: Synthetic oligonucleotide
ucagguuucuucaccucgg

SEQ ID NO: 2168 - RNA, 19 nt, Artificial Sequence
  Description of Artificial Sequence: Synthetic oligonucleotide
uuucuccgcagugccagga

SEQ ID NO: 2169 - RNA, 19 nt, Artificial Sequence
  Description of Artificial Sequence: Synthetic oligonucleotide
uggauguggaguuuccggg

SEQ ID NO: 2170 - RNA, 19 nt, Artificial Sequence
  Description of Artificial Sequence: Synthetic oligonucleotide
uaugcuucuugaccagagu

SEQ ID NO: 2171 - RNA, 19 nt, Artificial Sequence
  Description of Artificial Sequence: Synthetic oligonucleotide
uagcaucaugguaucuggg

SEQ ID NO: 2172 - RNA, 19 nt, Artificial Sequence
  Description of Artificial Sequence: Synthetic oligonucleotide
ugcacccaugugucucagg

SEQ ID NO: 2173 - RNA, 19 nt, Artificial Sequence
  Description of Artificial Sequence: Synthetic oligonucleotide
uugcucgcaguuguagugc

SEQ ID NO: 2174 - RNA, 19 nt, Artificial Sequence
  Description of Artificial Sequence: Synthetic oligonucleotide
uuuguccaccaucuugugg

SEQ ID NO: 2175 - RNA, 19 nt, Artificial Sequence
  Description of Artificial Sequence: Synthetic oligonucleotide
uggguugccaucugugucc

SEQ ID NO: 2176 - RNA, 19 nt, Artificial Sequence
  Description of Artificial Sequence: Synthetic oligonucleotide
uuuugguuagcagcuuuuc

SEQ ID NO: 2177 - RNA, 19 nt, Artificial Sequence
  Description of Artificial Sequence: Synthetic oligonucleotide
uagugcucgcaguuguagu

SEQ ID NO: 2178 - RNA, 19 nt, Artificial Sequence
  Description of Artificial Sequence: Synthetic oligonucleotide
uaaguugaucuuggagugc

SEQ ID NO: 2179 - RNA, 19 nt, Artificial Sequence
  Description of Artificial Sequence: Synthetic oligonucleotide
uuuagcagcuuuucaaggc

SEQ ID NO: 2180 - RNA, 19 nt, Artificial Sequence
  Description of Artificial Sequence: Synthetic oligonucleotide
ugguauaggaccgagucac

SEQ ID NO: 2181 - RNA, 19 nt, Artificial Sequence
  Description of Artificial Sequence: Synthetic oligonucleotide
uaugggucaccuccaccac

SEQ ID NO: 2182 - RNA, 19 nt, Artificial Sequence
  Description of Artificial Sequence: Synthetic oligonucleotide
ucuauaacucgucucgcau

SEQ ID NO: 2183 - RNA, 19 nt, Artificial Sequence
  Description of Artificial Sequence: Synthetic oligonucleotide
uaauucuagcugggaaggu

SEQ ID NO: 2184 - RNA, 19 nt, Artificial Sequence
  Description of Artificial Sequence: Synthetic oligonucleotide
ugagugaauucuagcuggg

SEQ ID NO: 2185 - RNA, 19 nt, Artificial Sequence
  Description of Artificial Sequence: Synthetic oligonucleotide
uuccacguccuuggugacc

SEQ ID NO: 2186 - RNA, 19 nt, Artificial Sequence
  Description of Artificial Sequence: Synthetic oligonucleotide
uugugugcacccugaggcc

SEQ ID NO: 2187 - RNA, 19 nt, Artificial Sequence
  Description of Artificial Sequence: Synthetic oligonucleotide
uuccaaggcugguaccuca

SEQ ID NO: 2188 - RNA, 19 nt, Artificial Sequence
  Description of Artificial Sequence: Synthetic oligonucleotide
uuaggaccgagucaccaug

SEQ ID NO: 2189 - RNA, 19 nt, Artificial Sequence
  Description of Artificial Sequence: Synthetic oligonucleotide
ucaaggcugguaccucacc

SEQ ID NO: 2190 - RNA, 19 nt, Artificial Sequence
  Description of Artificial Sequence: Synthetic oligonucleotide
uagguuucuucaccucggc

SEQ ID NO: 2191 - RNA, 19 nt, Artificial Sequence
  Description of Artificial Sequence: Synthetic oligonucleotide
uacugagcuggguccguac

SEQ ID NO: 2192 - RNA, 19 nt, Artificial Sequence
  Description of Artificial Sequence: Synthetic oligonucleotide
uagguacagguccuucuug

SEQ ID NO: 2193 - RNA, 19 nt, Artificial Sequence
  Description of Artificial Sequence: Synthetic oligonucleotide
uguugaucuuggagugcuc

SEQ ID NO: 2194 - RNA, 19 nt, Artificial Sequence
  Description of Artificial Sequence: Synthetic oligonucleotide
uuguggcuugaagaacaug

SEQ ID NO: 2195 - RNA, 19 nt, Artificial Sequence
  Description of Artificial Sequence: Synthetic oligonucleotide
ucgcugagaagcaggaggg

SEQ ID NO: 2196 - RNA, 19 nt, Artificial Sequence
  Description of Artificial Sequence: Synthetic oligonucleotide
uguccuucuugccugacau

SEQ ID NO: 2197 - RNA, 19 nt, Artificial Sequence
  Description of Artificial Sequence: Synthetic oligonucleotide
uucgcggaaguugaucuug

SEQ ID NO: 2198 - RNA, 19 nt, Artificial Sequence
  Description of Artificial Sequence: Synthetic oligonucleotide
ucgguggcguggaacacgc

SEQ ID NO: 2199 - RNA, 19 nt, Artificial Sequence
  Description of Artificial Sequence: Synthetic oligonucleotide
ucucacugagcuggguccg

SEQ ID NO: 2200 - RNA, 19 nt, Artificial Sequence
  Description of Artificial Sequence: Synthetic oligonucleotide
uccugguacaagcugaagg

SEQ ID NO: 2201 - RNA, 19 nt, Artificial Sequence
  Description of Artificial Sequence: Synthetic oligonucleotide
uaugaugaggcuggagagc

SEQ ID NO: 2202 - RNA, 19 nt, Artificial Sequence
  Description of Artificial Sequence: Synthetic oligonucleotide
uagagcuugugggccaggg

SEQ ID NO: 2203 - RNA, 19 nt, Artificial Sequence
  Description of Artificial Sequence: Synthetic oligonucleotide
uuccuuggugaccucgggc

SEQ ID NO: 2204 - RNA, 19 nt, Artificial Sequence
  Description of Artificial Sequence: Synthetic oligonucleotide
ucaccaggauguucuccac

SEQ ID NO: 2205 - RNA, 19 nt, Artificial Sequence
  Description of Artificial Sequence: Synthetic oligonucleotide
uuggaguugcugagugagc

SEQ ID NO: 2206 - RNA, 19 nt, Artificial Sequence
  Description of Artificial Sequence: Synthetic oligonucleotide
ugcuugaagaacauggcgu

SEQ ID NO: 2207 - RNA, 19 nt, Artificial Sequence
  Description of Artificial Sequence: Synthetic oligonucleotide
uccaauagcacccaugugu

SEQ ID NO: 2208 - RNA, 19 nt, Artificial Sequence
  Description of Artificial Sequence: Synthetic oligonucleotide
ucgaagcucacugagcugg

SEQ ID NO: 2209 - RNA, 19 nt, Artificial Sequence
  Description of Artificial Sequence: Synthetic oligonucleotide
ugaagcucacugagcuggg

SEQ ID NO: 2210 - RNA, 19 nt, Artificial Sequence
  Description of Artificial Sequence: Synthetic oligonucleotide
uguggucgccuugccgccc

SEQ ID NO: 2211 - RNA, 19 nt, Artificial Sequence
  Description of Artificial Sequence: Synthetic oligonucleotide
ucauccugugugcacccug

SEQ ID NO: 2212 - RNA, 19 nt, Artificial Sequence
  Description of Artificial Sequence: Synthetic oligonucleotide
ucugcagguuucuucaccu

SEQ ID NO: 2213 - RNA, 19 nt, Artificial Sequence
  Description of Artificial Sequence: Synthetic oligonucleotide
uuuuuauaguugggagagg

SEQ ID NO: 2214 - RNA, 19 nt, Artificial Sequence
  Description of Artificial Sequence: Synthetic oligonucleotide
uagcuggguccguacaguc

SEQ ID NO: 2215 - RNA, 19 nt, Artificial Sequence
  Description of Artificial Sequence: Synthetic oligonucleotide
uccuccugggagcuccuuc

SEQ ID NO: 2216 - RNA, 19 nt, Artificial Sequence
  Description of Artificial Sequence: Synthetic oligonucleotide
uuucuugccugacaugcgu

SEQ ID NO: 2217 - RNA, 19 nt, Artificial Sequence
  Description of Artificial Sequence: Synthetic oligonucleotide
uacgguauaggaccgaguc

SEQ ID NO: 2218 - RNA, 19 nt, Artificial Sequence
  Description of Artificial Sequence: Synthetic oligonucleotide
ugugcucgcaguuguagug

SEQ ID NO: 2219 - RNA, 19 nt, Artificial Sequence
  Description of Artificial Sequence: Synthetic oligonucleotide
uuccgcagugccaggagcu

SEQ ID NO: 2220 - RNA, 19 nt, Artificial Sequence
  Description of Artificial Sequence: Synthetic oligonucleotide
ugcaucuugucacccuuag

SEQ ID NO: 2221 - RNA, 19 nt, Artificial Sequence
  Description of Artificial Sequence: Synthetic oligonucleotide
ugcucaauuuggucucaca

SEQ ID NO: 2222 - RNA, 19 nt, Artificial Sequence
  Description of Artificial Sequence: Synthetic oligonucleotide
ucaugcgugacaagucggc

SEQ ID NO: 2223 - RNA, 19 nt, Artificial Sequence
  Description of Artificial Sequence: Synthetic oligonucleotide
uaugccuccugccauccug

SEQ ID NO: 2224 - RNA, 19 nt, Artificial Sequence
  Description of Artificial Sequence: Synthetic oligonucleotide
uagucggccuuguucuugu

SEQ ID NO: 2225 - RNA, 19 nt, Artificial Sequence
  Description of Artificial Sequence: Synthetic oligonucleotide
ugaagcaggagggagcgca

SEQ ID NO: 2226 - RNA, 19 nt, Artificial Sequence
  Description of Artificial Sequence: Synthetic oligonucleotide
uugagcgcagcagcucgcc

SEQ ID NO: 2227 - RNA, 19 nt, Artificial Sequence
  Description of Artificial Sequence: Synthetic oligonucleotide
uaggccuguccggugcauc

SEQ ID NO: 2228 - RNA, 19 nt, Artificial Sequence
  Description of Artificial Sequence: Synthetic oligonucleotide
uuugccgcccagcgacacg

SEQ ID NO: 2229 - RNA, 19 nt, Artificial Sequence
  Description of Artificial Sequence: Synthetic oligonucleotide
uguugggagagguugggau

SEQ ID NO: 2230 - RNA, 19 nt, Artificial Sequence
  Description of Artificial Sequence: Synthetic oligonucleotide
ugguggucggcguagaaca

SEQ ID NO: 2231 - RNA, 19 nt, Artificial Sequence
  Description of Artificial Sequence: Synthetic oligonucleotide
uaagcugaaggccaggccg

SEQ ID NO: 2232 - RNA, 19 nt, Artificial Sequence
  Description of Artificial Sequence: Synthetic oligonucleotide
uacugccuuggccugcgac

SEQ ID NO: 2233 - RNA, 19 nt, Artificial Sequence
  Description of Artificial Sequence: Synthetic oligonucleotide
uagggcaggcagaaugacu

SEQ ID NO: 2234 - RNA, 19 nt, Artificial Sequence
  Description of Artificial Sequence: Synthetic oligonucleotide
ucggccaggucauucuggg

SEQ ID NO: 2235 - RNA, 19 nt, Artificial Sequence
  Description of Artificial Sequence: Synthetic oligonucleotide
ugguuguccaccaucuugu

SEQ ID NO: 2236 - RNA, 19 nt, Artificial Sequence
  Description of Artificial Sequence: Synthetic oligonucleotide
uaacauggcguugacuagc

SEQ ID NO: 2237 - RNA, 19 nt, Artificial Sequence
  Description of Artificial Sequence: Synthetic oligonucleotide
uacucaaaggcgguggcgu

SEQ ID NO: 2238 - RNA, 19 nt, Artificial Sequence
  Description of Artificial Sequence: Synthetic oligonucleotide
ugucgguggucugcgcggc

SEQ ID NO: 2239 - RNA, 19 nt, Artificial Sequence
  Description of Artificial Sequence: Synthetic oligonucleotide
uaggcgcccaaugaauagc

SEQ ID NO: 2240 - RNA, 19 nt, Artificial Sequence
  Description of Artificial Sequence: Synthetic oligonucleotide
uucagcgaagcucacugag

SEQ ID NO: 2241 - RNA, 19 nt, Artificial Sequence
  Description of Artificial Sequence: Synthetic oligonucleotide
uggcugguaccucaccucc

SEQ ID NO: 2242 - RNA, 19 nt, Artificial Sequence
  Description of Artificial Sequence: Synthetic oligonucleotide
ugcucagcacugccuuggc

SEQ ID NO: 2243 - RNA, 19 nt, Artificial Sequence
  Description of Artificial Sequence: Synthetic oligonucleotide
ugaugaugaggcuggagag

SEQ ID NO: 2244 - RNA, 19 nt, Artificial Sequence
  Description of Artificial Sequence: Synthetic oligonucleotide
uacugcggccaggucauuc

SEQ ID NO: 2245 - RNA, 19 nt, Artificial Sequence
  Description of Artificial Sequence: Synthetic oligonucleotide
uuauaggaccgagucacca

SEQ ID NO: 2246 - RNA, 19 nt, Artificial Sequence
  Description of Artificial Sequence: Synthetic oligonucleotide
ucaggugagaagguaccug

SEQ ID NO: 2247 - RNA, 19 nt, Artificial Sequence
  Description of Artificial Sequence: Synthetic oligonucleotide
uaaggcgguggcguggaac

SEQ ID NO: 2248 - RNA, 19 nt, Artificial Sequence
  Description of Artificial Sequence: Synthetic oligonucleotide
ucuggguccguacagucgg

SEQ ID NO: 2249 - RNA, 19 nt, Artificial Sequence
  Description of Artificial Sequence: Synthetic oligonucleotide
uuugccgucgguggucugc

SEQ ID NO: 2250 - RNA, 19 nt, Artificial Sequence
  Description of Artificial Sequence: Synthetic oligonucleotide
uuaacucgucucgcaucuu

SEQ ID NO: 2251 - RNA, 19 nt, Artificial Sequence
  Description of Artificial Sequence: Synthetic oligonucleotide
uaucuucagcugcucuuug

SEQ ID NO: 2252 - RNA, 19 nt, Artificial Sequence
  Description of Artificial Sequence: Synthetic oligonucleotide
ugcuuuuccuucucgucgu

SEQ ID NO: 2253 - RNA, 19 nt, Artificial Sequence
  Description of Artificial Sequence: Synthetic oligonucleotide
uccauguccaaguggagug

SEQ ID NO: 2254 - RNA, 19 nt, Artificial Sequence
  Description of Artificial Sequence: Synthetic oligonucleotide
ucccacucguugauggacu

SEQ ID NO: 2255 - RNA, 19 nt, Artificial Sequence
  Description of Artificial Sequence: Synthetic oligonucleotide
uugaaggccaggccggcgc

SEQ ID NO: 2256 - RNA, 19 nt, Artificial Sequence
  Description of Artificial Sequence: Synthetic oligonucleotide
uacgauuugcagcuuuucc

SEQ ID NO: 2257 - RNA, 19 nt, Artificial Sequence
  Description of Artificial Sequence: Synthetic oligonucleotide
ucacgcuccaacaaaaugu

SEQ ID NO: 2258 - RNA, 19 nt, Artificial Sequence
  Description of Artificial Sequence: Synthetic oligonucleotide
uucaccaugaagccacggu

SEQ ID NO: 2259 - RNA, 19 nt, Artificial Sequence
  Description of Artificial Sequence: Synthetic oligonucleotide
ucacuaggaagaugaaggg

SEQ ID NO: 2260 - RNA, 19 nt, Artificial Sequence
  Description of Artificial Sequence: Synthetic oligonucleotide
uaucuugugguggaauuuc

SEQ ID NO: 2261 - RNA, 19 nt, Artificial Sequence
  Description of Artificial Sequence: Synthetic oligonucleotide
ucagcaccuaguuuuauag

SEQ ID NO: 2262 - RNA, 19 nt, Artificial Sequence
  Description of Artificial Sequence: Synthetic oligonucleotide
uaggccggcgugcaccucc

SEQ ID NO: 2263 - RNA, 19 nt, Artificial Sequence
  Description of Artificial Sequence: Synthetic oligonucleotide
uagcacugccuuggccugc

SEQ ID NO: 2264 - RNA, 19 nt, Artificial Sequence
  Description of Artificial Sequence: Synthetic oligonucleotide
uuagcucaauuuggucuca

SEQ ID NO: 2265 - RNA, 19 nt, Artificial Sequence
  Description of Artificial Sequence: Synthetic oligonucleotide
uaggcagaaugacuauggc

SEQ ID NO: 2266 - RNA, 19 nt, Artificial Sequence
  Description of Artificial Sequence: Synthetic oligonucleotide
uccauccagaucuucagcu

SEQ ID NO: 2267 - RNA, 19 nt, Artificial Sequence
  Description of Artificial Sequence: Synthetic oligonucleotide
uccuugggcaaggagaugg

SEQ ID NO: 2268 - RNA, 19 nt, Artificial Sequence
  Description of Artificial Sequence: Synthetic oligonucleotide
uaggcaggcuugaucuggg

SEQ ID NO: 2269 - RNA, 19 nt, Artificial Sequence
  Description of Artificial Sequence: Synthetic oligonucleotide
ucaaggagauggcaacagc

SEQ ID NO: 2270 - RNA, 19 nt, Artificial Sequence
  Description of Artificial Sequence: Synthetic oligonucleotide
uacguccuuggugaccucg

SEQ ID NO: 2271 - RNA, 19 nt, Artificial Sequence
  Description of Artificial Sequence: Synthetic oligonucleotide
ucaccuaguuuuauaguug

SEQ ID NO: 2272 - RNA, 19 nt, Artificial Sequence
  Description of Artificial Sequence: Synthetic oligonucleotide
ugagauggcaacagccuuc

SEQ ID NO: 2273 - RNA, 19 nt, Artificial Sequence
  Description of Artificial Sequence: Synthetic oligonucleotide
ugggcucaacuucuccgca

SEQ ID NO: 2274 - RNA, 19 nt, Artificial Sequence
  Description of Artificial Sequence: Synthetic oligonucleotide
uacacccuugggcaaggag

SEQ ID NO: 2275 - RNA, 19 nt, Artificial Sequence
  Description of Artificial Sequence: Synthetic oligonucleotide
uaucugggacuuucagggc

SEQ ID NO: 2276 - RNA, 19 nt, Artificial Sequence
  Description of Artificial Sequence: Synthetic oligonucleotide
uaccuccaccacacccuug

SEQ ID NO: 2277 - RNA, 19 nt, Artificial Sequence
  Description of Artificial Sequence: Synthetic oligonucleotide
uagaucuucagcugcucuu

SEQ ID NO: 2278 - RNA, 19 nt, Artificial Sequence
  Description of Artificial Sequence: Synthetic oligonucleotide
ugccuucuucugcaucuuc

SEQ ID NO: 2279 - RNA, 19 nt, Artificial Sequence
  Description of Artificial Sequence: Synthetic oligonucleotide
ucaggauguggaguuuccg

SEQ ID NO: 2280 - RNA, 19 nt, Artificial Sequence
  Description of Artificial Sequence: Synthetic oligonucleotide
uaagaacauggcguugacu

SEQ ID NO: 2281 - RNA, 19 nt, Artificial Sequence
  Description of Artificial Sequence: Synthetic oligonucleotide
uagcuuuucaaggcgcucg

SEQ ID NO: 2282 - RNA, 19 nt, Artificial Sequence
  Description of Artificial Sequence: Synthetic oligonucleotide
uucaugacacccacgguau

SEQ ID NO: 2283 - RNA, 19 nt, Artificial Sequence
  Description of Artificial Sequence: Synthetic oligonucleotide
uaugacuauggcccagguc

SEQ ID NO: 2284 - RNA, 19 nt, Artificial Sequence
  Description of Artificial Sequence: Synthetic oligonucleotide
uuccuucuugccugacaug

SEQ ID NO: 2285 - RNA, 19 nt, Artificial Sequence
  Description of Artificial Sequence: Synthetic oligonucleotide
uccuauaacucgucucgca

SEQ ID NO: 2286 - RNA, 19 nt, Artificial Sequence
  Description of Artificial Sequence: Synthetic oligonucleotide
ucuuccaggucacguugcg

SEQ ID NO: 2287 - RNA, 19 nt, Artificial Sequence
  Description of Artificial Sequence: Synthetic oligonucleotide
uguuguagugcugcuugcu

SEQ ID NO: 2288 - RNA, 19 nt, Artificial Sequence
  Description of Artificial Sequence: Synthetic oligonucleotide
ucugagugagcgcagcagc

SEQ ID NO: 2289 - RNA, 19 nt, Artificial Sequence
  Description of Artificial Sequence: Synthetic oligonucleotide
ucuguccggugcaucauca

SEQ ID NO: 2290 - RNA, 19 nt, Artificial Sequence
  Description of Artificial Sequence: Synthetic oligonucleotide
uuuggauugauagcaacaa

SEQ ID NO: 2291 - RNA, 19 nt, Artificial Sequence
  Description of Artificial Sequence: Synthetic oligonucleotide
uguuagcagcuuuucaagg

SEQ ID NO: 2292 - RNA, 19 nt, Artificial Sequence
  Description of Artificial Sequence: Synthetic oligonucleotide
ugauguccuggucaaaggg

SEQ ID NO: 2293 - RNA, 19 nt, Artificial Sequence
  Description of Artificial Sequence: Synthetic oligonucleotide
uugcagguuucuucaccuc

SEQ ID NO: 2294 - RNA, 19 nt, Artificial Sequence
  Description of Artificial Sequence: Synthetic oligonucleotide
ucuccaccacacccuuggg

SEQ ID NO: 2295 - RNA, 19 nt, Artificial Sequence
  Description of Artificial Sequence: Synthetic oligonucleotide
ugcccaaugaauagcaggg

SEQ ID NO: 2296 - RNA, 19 nt, Artificial Sequence
  Description of Artificial Sequence: Synthetic oligonucleotide
uuugaucugggacuuucag

SEQ ID NO: 2297 - RNA, 19 nt, Artificial Sequence
  Description of Artificial Sequence: Synthetic oligonucleotide
uaucuccacgauuugcagc

SEQ ID NO: 2298 - RNA, 19 nt, Artificial Sequence
  Description of Artificial Sequence: Synthetic oligonucleotide
ucugauugaggcaggcuug

SEQ ID NO: 2299 - RNA, 19 nt, Artificial Sequence
  Description of Artificial Sequence: Synthetic oligonucleotide
uucgucgcgcagcugcucg

SEQ ID NO: 2300 - RNA, 19 nt, Artificial Sequence
  Description of Artificial Sequence: Synthetic oligonucleotide
uugcgugacaagucggccu

SEQ ID NO: 2301 - RNA, 19 nt, Artificial Sequence
  Description of Artificial Sequence: Synthetic oligonucleotide
uagugccaggagcugcugc

SEQ ID NO: 2302 - RNA, 19 nt, Artificial Sequence
  Description of Artificial Sequence: Synthetic oligonucleotide
uggcagaaugacuauggcc

SEQ ID NO: 2303 - RNA, 19 nt, Artificial Sequence
  Description of Artificial Sequence: Synthetic oligonucleotide
uuccgcucaggcacacggg

SEQ ID NO: 2304 - RNA, 19 nt, Artificial Sequence
  Description of Artificial Sequence: Synthetic oligonucleotide
ucauccagaucuucagcug

SEQ ID NO: 2305 - RNA, 19 nt, Artificial Sequence
  Description of Artificial Sequence: Synthetic oligonucleotide
uucaucccaguguggcuug

SEQ ID NO: 2306 - RNA, 19 nt, Artificial Sequence
  Description of Artificial Sequence: Synthetic oligonucleotide
uuccaaguggagugaauuc

SEQ ID NO: 2307 - RNA, 19 nt, Artificial Sequence
  Description of Artificial Sequence: Synthetic oligonucleotide
uuugacuagcagggcgccg

SEQ ID NO: 2308 - RNA, 19 nt, Artificial Sequence
  Description of Artificial Sequence: Synthetic oligonucleotide
uucggcugcccagcuucca

SEQ ID NO: 2309 - RNA, 19 nt, Artificial Sequence
  Description of Artificial Sequence: Synthetic oligonucleotide
ucgccguggucgccuugcc

SEQ ID NO: 2310 - RNA, 19 nt, Artificial Sequence
  Description of Artificial Sequence: Synthetic oligonucleotide
ucucaacuucuccgcagug

SEQ ID NO: 2311 - RNA, 19 nt, Artificial Sequence
  Description of Artificial Sequence: Synthetic oligonucleotide
ucuuuggaugccuccugcc

SEQ ID NO: 2312 - RNA, 19 nt, Artificial Sequence
  Description of Artificial Sequence: Synthetic oligonucleotide
uguauaggaccgagucacc

SEQ ID NO: 2313 - RNA, 19 nt, Artificial Sequence
  Description of Artificial Sequence: Synthetic oligonucleotide
uaagguaccuggcuauaaa

SEQ ID NO: 2314 - RNA, 19 nt, Artificial Sequence
  Description of Artificial Sequence: Synthetic oligonucleotide
uugguccuuggccauggcc

SEQ ID NO: 2315 - RNA, 19 nt, Artificial Sequence
  Description of Artificial Sequence: Synthetic oligonucleotide
ucuucccucccuaucuuug

SEQ ID NO: 2316 - RNA, 19 nt, Artificial Sequence
  Description of Artificial Sequence: Synthetic oligonucleotide
uuguuuuagugucagaaga

SEQ ID NO: 2317 - RNA, 19 nt, Artificial Sequence
  Description of Artificial Sequence: Synthetic oligonucleotide
uguguuuuagugucagaag

SEQ ID NO: 2318 - RNA, 19 nt, Artificial Sequence
  Description of Artificial Sequence: Synthetic oligonucleotide
uucgagaggcuccacguga

SEQ ID NO: 2319 - RNA, 19 nt, Artificial Sequence
  Description of Artificial Sequence: Synthetic oligonucleotide
uccacucguugauggacug

SEQ ID NO: 2320 - RNA, 19 nt, Artificial Sequence
  Description of Artificial Sequence: Synthetic oligonucleotide
uccuagcucaauuuggucu

SEQ ID NO: 2321 - RNA, 19 nt, Artificial Sequence
  Description of Artificial Sequence: Synthetic oligonucleotide
uucaggcacacgggaaccc

SEQ ID NO: 2322 - RNA, 19 nt, Artificial Sequence
  Description of Artificial Sequence: Synthetic oligonucleotide
uuucuuggauugauagcaa

SEQ ID NO: 2323 - RNA, 19 nt, Artificial Sequence
  Description of Artificial Sequence: Synthetic oligonucleotide
uaccaugaagccacgguug

SEQ ID NO: 2324 - RNA, 19 nt, Artificial Sequence
  Description of Artificial Sequence: Synthetic oligonucleotide
uugagcuggguccguacag

SEQ ID NO: 2325 - RNA, 19 nt, Artificial Sequence
  Description of Artificial Sequence: Synthetic oligonucleotide
uuagugcugcuugcugcug

SEQ ID NO: 2326 - RNA, 19 nt, Artificial Sequence
  Description of Artificial Sequence: Synthetic oligonucleotide
uagcugcugcggcugcagg

SEQ ID NO: 2327 - RNA, 19 nt, Artificial Sequence
  Description of Artificial Sequence: Synthetic oligonucleotide
ucugagguguuuuaguguc

SEQ ID NO: 2328 - RNA, 19 nt, Artificial Sequence
  Description of Artificial Sequence: Synthetic oligonucleotide
uuuggagugcucgcaguug

SEQ ID NO: 2329 - RNA, 19 nt, Artificial Sequence
  Description of Artificial Sequence: Synthetic oligonucleotide
ugcucaacuucuccgcagu

SEQ ID NO: 2330 - RNA, 19 nt, Artificial Sequence
  Description of Artificial Sequence: Synthetic oligonucleotide
ucguugacuagcagggcgc

SEQ ID NO: 2331 - RNA, 19 nt, Artificial Sequence
  Description of Artificial Sequence: Synthetic oligonucleotide
ugucggcugcccagcuucc

SEQ ID NO: 2332 - RNA, 19 nt, Artificial Sequence
  Description of Artificial Sequence: Synthetic oligonucleotide
ucaugugucucaggagccu

SEQ ID NO: 2333 - RNA, 19 nt, Artificial Sequence
  Description of Artificial Sequence: Synthetic oligonucleotide
uagcgcgcugcgcuugucg

SEQ ID NO: 2334 - RNA, 19 nt, Artificial Sequence
  Description of Artificial Sequence: Synthetic oligonucleotide
uaucagcgaagcucacuga

SEQ ID NO: 2335 - RNA, 19 nt, Artificial Sequence
  Description of Artificial Sequence: Synthetic oligonucleotide
ucugggagcuccuucucaa

SEQ ID NO: 2336 - RNA, 19 nt, Artificial Sequence
  Description of Artificial Sequence: Synthetic oligonucleotide
uucuuggagugcucgcagu

SEQ ID NO: 2337 - RNA, 19 nt, Artificial Sequence
  Description of Artificial Sequence: Synthetic oligonucleotide
uacgggugacaccaggaug

SEQ ID NO: 2338 - RNA, 19 nt, Artificial Sequence
  Description of Artificial Sequence: Synthetic oligonucleotide
ucugcuugcugcugcgcac

SEQ ID NO: 2339 - RNA, 19 nt, Artificial Sequence
  Description of Artificial Sequence: Synthetic oligonucleotide
ucucaaaggcgguggcgug

SEQ ID NO: 2340 - RNA, 19 nt, Artificial Sequence
  Description of Artificial Sequence: Synthetic oligonucleotide
uuuuucaaggcgcucgaga

SEQ ID NO: 2341 - RNA, 19 nt, Artificial Sequence
  Description of Artificial Sequence: Synthetic oligonucleotide
ucgaagucaucagcgaagc

SEQ ID NO: 2342 - RNA, 19 nt, Artificial Sequence
  Description of Artificial Sequence: Synthetic oligonucleotide
ucacccuugggcaaggaga

SEQ ID NO: 2343 - RNA, 19 nt, Artificial Sequence
  Description of Artificial Sequence: Synthetic oligonucleotide
ucacucguugauggacugc

SEQ ID NO: 2344 - RNA, 19 nt, Artificial Sequence
  Description of Artificial Sequence: Synthetic oligonucleotide
ucacgguuguccaccaucu

SEQ ID NO: 2345 - RNA, 19 nt, Artificial Sequence
  Description of Artificial Sequence: Synthetic oligonucleotide
uaugaauagcagggagccg

SEQ ID NO: 2346 - RNA, 19 nt, Artificial Sequence
  Description of Artificial Sequence: Synthetic oligonucleotide
uggcucagcaucaugguau

SEQ ID NO: 2347 - RNA, 19 nt, Artificial Sequence
  Description of Artificial Sequence: Synthetic oligonucleotide
ugugagaagguaccuggcu

SEQ ID NO: 2348 - RNA, 19 nt, Artificial Sequence
  Description of Artificial Sequence: Synthetic oligonucleotide
uuguggaguuuccgggcuc

SEQ ID NO: 2349 - RNA, 19 nt, Artificial Sequence
  Description of Artificial Sequence: Synthetic oligonucleotide
ucgcagugccaggagcugc

SEQ ID NO: 2350 - RNA, 19 nt, Artificial Sequence
  Description of Artificial Sequence: Synthetic oligonucleotide
uguccuuggugaccucggg

SEQ ID NO: 2351 - RNA, 19 nt, Artificial Sequence
  Description of Artificial Sequence: Synthetic oligonucleotide
uucaauggccucagucagg

SEQ ID NO: 2352 - RNA, 19 nt, Artificial Sequence
  Description of Artificial Sequence: Synthetic oligonucleotide
ugaguuuccgggcucagca

SEQ ID NO: 2353 - RNA, 19 nt, Artificial Sequence
  Description of Artificial Sequence: Synthetic oligonucleotide
ucuugggcaaggagauggc

SEQ ID NO: 2354 - RNA, 19 nt, Artificial Sequence
  Description of Artificial Sequence: Synthetic oligonucleotide
ucaguuguagugcugcuug

SEQ ID NO: 2355 - RNA, 19 nt, Artificial Sequence
  Description of Artificial Sequence: Synthetic oligonucleotide
ugcgcucagcacugccuug

SEQ ID NO: 2356 - RNA, 19 nt, Artificial Sequence
  Description of Artificial Sequence: Synthetic oligonucleotide
uuccaacaaaaugucauug

SEQ ID NO: 2357 - RNA, 19 nt, Artificial Sequence
  Description of Artificial Sequence: Synthetic oligonucleotide
uucaucagcgaagcucacu

SEQ ID NO: 2358 - RNA, 19 nt, Artificial Sequence
  Description of Artificial Sequence: Synthetic oligonucleotide
uuguccggugcaucaucau

SEQ ID NO: 2359 - RNA, 19 nt, Artificial Sequence
  Description of Artificial Sequence: Synthetic oligonucleotide
uagcccagccagguguuuc

SEQ ID NO: 2360 - RNA, 19 nt, Artificial Sequence
  Description of Artificial Sequence: Synthetic oligonucleotide
ucgcccaaugaauagcagg

SEQ ID NO: 2361 - RNA, 19 nt, Artificial Sequence
  Description of Artificial Sequence: Synthetic oligonucleotide
uaacucaaaggcgguggcg

SEQ ID NO: 2362 - RNA, 19 nt, Artificial Sequence
  Description of Artificial Sequence: Synthetic oligonucleotide
ucagaaggcgcugagaagc

SEQ ID NO: 2363 - RNA, 19 nt, Artificial Sequence
  Description of Artificial Sequence: Synthetic oligonucleotide
uuuuccgggcucagcauca

SEQ ID NO: 2364 - RNA, 19 nt, Artificial Sequence
  Description of Artificial Sequence: Synthetic oligonucleotide
ucucacugcggccagguca

SEQ ID NO: 2365 - RNA, 19 nt, Artificial Sequence
  Description of Artificial Sequence: Synthetic oligonucleotide
ucagccagguguuucugca

SEQ ID NO: 2366 - RNA, 19 nt, Artificial Sequence
  Description of Artificial Sequence: Synthetic oligonucleotide
ucucggcgcucagcacugc

SEQ ID NO: 2367 - RNA, 19 nt, Artificial Sequence
  Description of Artificial Sequence: Synthetic oligonucleotide
uaggucacguugcgcgccg

SEQ ID NO: 2368 - RNA, 19 nt, Artificial Sequence
  Description of Artificial Sequence: Synthetic oligonucleotide
uugcucggcgcucagcacu

SEQ ID NO: 2369 - RNA, 19 nt, Artificial Sequence
  Description of Artificial Sequence: Synthetic oligonucleotide
uguaguuguagaggccugu

SEQ ID NO: 2370 - RNA, 19 nt, Artificial Sequence
  Description of Artificial Sequence: Synthetic oligonucleotide
uuccucgucgcgcagcugc

SEQ ID NO: 2371 - RNA, 19 nt, Artificial Sequence
  Description of Artificial Sequence: Synthetic oligonucleotide
uugggagcuccuucucaau

SEQ ID NO: 2372 - RNA, 19 nt, Artificial Sequence
  Description of Artificial Sequence: Synthetic oligonucleotide
uccgucgguggucugcgcg

SEQ ID NO: 2373 - RNA, 19 nt, Artificial Sequence
  Description of Artificial Sequence: Synthetic oligonucleotide
uacgcuggccagguacagg

SEQ ID NO: 2374 - RNA, 19 nt, Artificial Sequence
  Description of Artificial Sequence: Synthetic oligonucleotide
ucugggaagguccgcucag

SEQ ID NO: 2375 - RNA, 19 nt, Artificial Sequence
  Description of Artificial Sequence: Synthetic oligonucleotide
uugguacaagcugaaggcc

SEQ ID NO: 2376 - RNA, 19 nt, Artificial Sequence
  Description of Artificial Sequence: Synthetic oligonucleotide
uagggagccgcuuugggug

SEQ ID NO: 2377 - RNA, 19 nt, Artificial Sequence
  Description of Artificial Sequence: Synthetic oligonucleotide
ucacugccugguccuuggc

SEQ ID NO: 2378 - RNA, 19 nt, Artificial Sequence
  Description of Artificial Sequence: Synthetic oligonucleotide
uuccugugugcacccugag

SEQ ID NO: 2379 - RNA, 19 nt, Artificial Sequence
  Description of Artificial Sequence: Synthetic oligonucleotide
uagugagcgcagcagcucg

SEQ ID NO: 2380 - RNA, 19 nt, Artificial Sequence
  Description of Artificial Sequence: Synthetic oligonucleotide
uccucagucaggcccagcc

SEQ ID NO: 2381 - RNA, 19 nt, Artificial Sequence
  Description of Artificial Sequence: Synthetic oligonucleotide
uugccaggagcugcugcgg

SEQ ID NO: 2382 - RNA, 19 nt, Artificial Sequence
  Description of Artificial Sequence: Synthetic oligonucleotide
uuauggcccaggucccaca

SEQ ID NO: 2383 - RNA, 19 nt, Artificial Sequence
  Description of Artificial Sequence: Synthetic oligonucleotide
uagccuucuucugcaucuu

SEQ ID NO: 2384 - RNA, 19 nt, Artificial Sequence
  Description of Artificial Sequence: Synthetic oligonucleotide
uucacguugcgcgccgugg

SEQ ID NO: 2385 - RNA, 19 nt, Artificial Sequence
  Description of Artificial Sequence: Synthetic oligonucleotide
uucucacaggugagaaggu

SEQ ID NO: 2386 - RNA, 19 nt, Artificial Sequence
  Description of Artificial Sequence: Synthetic oligonucleotide
ucggcugcagguuucuuca

SEQ ID NO: 2387 - RNA, 19 nt, Artificial Sequence
  Description of Artificial Sequence: Synthetic oligonucleotide
ucucgcaguuguagugcug

SEQ ID NO: 2388 - RNA, 19 nt, Artificial Sequence
  Description of Artificial Sequence: Synthetic oligonucleotide
ugcgcgcugcgcuugucgc

SEQ ID NO: 2389 - RNA, 19 nt, Artificial Sequence
  Description of Artificial Sequence: Synthetic oligonucleotide
ucaaguggagugaauucua

SEQ ID NO: 2390 - RNA, 19 nt, Artificial Sequence
  Description of Artificial Sequence: Synthetic oligonucleotide
ucccggucuguuuuuccac

SEQ ID NO: 2391 - RNA, 19 nt, Artificial Sequence
  Description of Artificial Sequence: Synthetic oligonucleotide
ugcucgagaggcuccacgu

SEQ ID NO: 2392 - RNA, 19 nt, Artificial Sequence
  Description of Artificial Sequence: Synthetic oligonucleotide
ucaggucacguugcgcgcc

SEQ ID NO: 2393 - RNA, 19 nt, Artificial Sequence
  Description of Artificial Sequence: Synthetic oligonucleotide
uugaagccacgguugucca

SEQ ID NO: 2394 - RNA, 19 nt, Artificial Sequence
  Description of Artificial Sequence: Synthetic oligonucleotide
ugaacauggcguugacuag

SEQ ID NO: 2395 - RNA, 19 nt, Artificial Sequence
  Description of Artificial Sequence: Synthetic oligonucleotide
ucugcggccaggucauucu

SEQ ID NO: 2396 - RNA, 19 nt, Artificial Sequence
  Description of Artificial Sequence: Synthetic oligonucleotide
uugagugagcgcagcagcu

SEQ ID NO: 2397 - RNA, 19 nt, Artificial Sequence
  Description of Artificial Sequence: Synthetic oligonucleotide
uggagagguugggauagag

SEQ ID NO: 2398 - RNA, 19 nt, Artificial Sequence
  Description of Artificial Sequence: Synthetic oligonucleotide
ugugagcgcagcagcucgc

SEQ ID NO: 2399 - RNA, 19 nt, Artificial Sequence
  Description of Artificial Sequence: Synthetic oligonucleotide
ugugcugcuugcugcugcg

SEQ ID NO: 2400 - RNA, 19 nt, Artificial Sequence
  Description of Artificial Sequence: Synthetic oligonucleotide
ugucaggcccagcccagcc

SEQ ID NO: 2401 - RNA, 19 nt, Artificial Sequence
  Description of Artificial Sequence: Synthetic oligonucleotide
uggaugaugaggcuggaga

SEQ ID NO: 2402 - RNA, 19 nt, Artificial Sequence
  Description of Artificial Sequence: Synthetic oligonucleotide
uuugaagaacauggcguug

SEQ ID NO: 2403 - RNA, 19 nt, Artificial Sequence
  Description of Artificial Sequence: Synthetic oligonucleotide
uaacuucuccgcagugcca

SEQ ID NO: 2404 - RNA, 19 nt, Artificial Sequence
  Description of Artificial Sequence: Synthetic oligonucleotide
uaucuguguccaacucaaa

SEQ ID NO: 2405 - RNA, 19 nt, Artificial Sequence
  Description of Artificial Sequence: Synthetic oligonucleotide
uagcgcagcagcucgccca

SEQ ID NO: 2406 - RNA, 19 nt, Artificial Sequence
  Description of Artificial Sequence: Synthetic oligonucleotide
ucugcucuuugguuagcag

SEQ ID NO: 2407 - RNA, 19 nt, Artificial Sequence
  Description of Artificial Sequence: Synthetic oligonucleotide
ucagcuuccaggucacguu

SEQ ID NO: 2408 - RNA, 19 nt, Artificial Sequence
  Description of Artificial Sequence: Synthetic oligonucleotide
ugcuccaacaaaaugucau

SEQ ID NO: 2409 - RNA, 19 nt, Artificial Sequence
  Description of Artificial Sequence: Synthetic oligonucleotide
ugccuuuggaugccuccug

SEQ ID NO: 2410 - RNA, 19 nt, Artificial Sequence
  Description of Artificial Sequence: Synthetic oligonucleotide
uacccuugggcaaggagau

SEQ ID NO: 2411 - RNA, 19 nt, Artificial Sequence
  Description of Artificial Sequence: Synthetic oligonucleotide
uguggaauuucucauccca

SEQ ID NO: 2412 - RNA, 19 nt, Artificial Sequence
  Description of Artificial Sequence: Synthetic oligonucleotide
uucuuugguuagcagcuuu

SEQ ID NO: 2413 - RNA, 19 nt, Artificial Sequence
  Description of Artificial Sequence: Synthetic oligonucleotide
uagccuuuggaugccuccu

SEQ ID NO: 2414 - RNA, 19 nt, Artificial Sequence
  Description of Artificial Sequence: Synthetic oligonucleotide
uuccaacucaaaggcggug

SEQ ID NO: 2415 - RNA, 19 nt, Artificial Sequence
  Description of Artificial Sequence: Synthetic oligonucleotide
uaccuaguuuuauaguugg

SEQ ID NO: 2416 - RNA, 19 nt, Artificial Sequence
  Description of Artificial Sequence: Synthetic oligonucleotide
ucagacacgaugcuucuug

SEQ ID NO: 2417 - RNA, 19 nt, Artificial Sequence
  Description of Artificial Sequence: Synthetic oligonucleotide
uuccagaucuucagcugcu

SEQ ID NO: 2418 - RNA, 19 nt, Artificial Sequence
  Description of Artificial Sequence: Synthetic oligonucleotide
uagaagcaggagggagcgc

SEQ ID NO: 2419 - RNA, 19 nt, Artificial Sequence
  Description of Artificial Sequence: Synthetic oligonucleotide
uacauggcguugacuagca

SEQ ID NO: 2420 - RNA, 19 nt, Artificial Sequence
  Description of Artificial Sequence: Synthetic oligonucleotide
uucgcgcagcugcucggcg

SEQ ID NO: 2421 - RNA, 19 nt, Artificial Sequence
  Description of Artificial Sequence: Synthetic oligonucleotide
ucgucgguggucugcgcgg

SEQ ID NO: 2422 - RNA, 19 nt, Artificial Sequence
  Description of Artificial Sequence: Synthetic oligonucleotide
uugagaagguaccuggcua

SEQ ID NO: 2423 - RNA, 19 nt, Artificial Sequence
  Description of Artificial Sequence: Synthetic oligonucleotide
uagaaggcgcugagaagca

SEQ ID NO: 2424 - RNA, 19 nt, Artificial Sequence
  Description of Artificial Sequence: Synthetic oligonucleotide
ucugagaagcaggagggag

SEQ ID NO: 2425 - RNA, 19 nt, Artificial Sequence
  Description of Artificial Sequence: Synthetic oligonucleotide
ugcacugccuuggccugcg

SEQ ID NO: 2426 - RNA, 19 nt, Artificial Sequence
  Description of Artificial Sequence: Synthetic oligonucleotide
uacgccguggucgccuugc

SEQ ID NO: 2427 - RNA, 19 nt, Artificial Sequence
  Description of Artificial Sequence: Synthetic oligonucleotide
uaggagcugcugcggcugc

SEQ ID NO: 2428 - RNA, 19 nt, Artificial Sequence
  Description of Artificial Sequence: Synthetic oligonucleotide
ucaccaaggacguggagca

SEQ ID NO: 2429 - RNA, 19 nt, Artificial Sequence
  Description of Artificial Sequence: Synthetic oligonucleotide
cagcgcgcugcaguccaua

SEQ ID NO: 2430 - RNA, 19 nt, Artificial Sequence
  Description of Artificial Sequence: Synthetic oligonucleotide
caucuacgggcgcgaggaa

SEQ ID NO: 2431 - RNA, 19 nt, Artificial Sequence
  Description of Artificial Sequence: Synthetic oligonucleotide
cuccagccucaucauccua

SEQ ID NO: 2432 - RNA, 19 nt, Artificial Sequence
  Description of Artificial Sequence: Synthetic oligonucleotide
gacaucuacgggcgcgaga

SEQ ID NO: 2433 - RNA, 19 nt, Artificial Sequence
  Description of Artificial Sequence: Synthetic oligonucleotide
cgugcgcagcagcaagcaa

SEQ ID NO: 2434 - RNA, 19 nt, Artificial Sequence
  Description of Artificial Sequence: Synthetic oligonucleotide
gucaccaaggacguggaga

SEQ ID NO: 2435 - RNA, 19 nt, Artificial Sequence
  Description of Artificial Sequence: Synthetic oligonucleotide
ccgcgacaagcgcagcgca

SEQ ID NO: 2436 - RNA, 19 nt, Artificial Sequence
  Description of Artificial Sequence: Synthetic oligonucleotide
gcgcagcgcgcugcaguca

SEQ ID NO: 2437 - RNA, 19 nt, Artificial Sequence
  Description of Artificial Sequence: Synthetic oligonucleotide
ggcccacaagcucuccaga

SEQ ID NO: 2438 - RNA, 19 nt, Artificial Sequence
  Description of Artificial Sequence: Synthetic oligonucleotide
caaggacguggagcgcaca

SEQ ID NO: 2439 - RNA, 19 nt, Artificial Sequence
  Description of Artificial Sequence: Synthetic oligonucleotide
agccucaucauccucauga

SEQ ID NO: 2440 - RNA, 19 nt, Artificial Sequence
  Description of Artificial Sequence: Synthetic oligonucleotide
ggugugguggaggugacca

SEQ ID NO: 2441 - RNA, 19 nt, Artificial Sequence
  Description of Artificial Sequence: Synthetic oligonucleotide
gcaagcugcccgaggucaa

SEQ ID NO: 2442 - RNA, 19 nt, Artificial Sequence
  Description of Artificial Sequence: Synthetic oligonucleotide
guggaggugacccaugaca

SEQ ID NO: 2443 - RNA, 19 nt, Artificial Sequence
  Description of Artificial Sequence: Synthetic oligonucleotide
cacaagaugguggacaaca

SEQ ID NO: 2444 - RNA, 19 nt, Artificial Sequence
  Description of Artificial Sequence: Synthetic oligonucleotide
gcgaggagcugcgcagcca

SEQ ID NO: 2445 - RNA, 19 nt, Artificial Sequence
  Description of Artificial Sequence: Synthetic oligonucleotide
uacuacgacgacgagaaga

SEQ ID NO: 2446 - RNA, 19 nt, Artificial Sequence
  Description of Artificial Sequence: Synthetic oligonucleotide
gaggugacccaugaccuga

SEQ ID NO: 2447 - RNA, 19 nt, Artificial Sequence
  Description of Artificial Sequence: Synthetic oligonucleotide
acuuccgcgacaagcgcaa

SEQ ID NO: 2448 - RNA, 19 nt, Artificial Sequence
  Description of Artificial Sequence: Synthetic oligonucleotide
gcccacaagcucuccagca

SEQ ID NO: 2449 - RNA, 19 nt, Artificial Sequence
  Description of Artificial Sequence: Synthetic oligonucleotide
gcgcagcagcaagcagcaa

SEQ ID NO: 2450 - RNA, 19 nt, Artificial Sequence
  Description of Artificial Sequence: Synthetic oligonucleotide
cgaggagcugcgcagccca

SEQ ID NO: 2451 - RNA, 19 nt, Artificial Sequence
  Description of Artificial Sequence: Synthetic oligonucleotide
aacgccauguucuucaaga

SEQ ID NO: 2452 - RNA, 19 nt, Artificial Sequence
  Description of Artificial Sequence: Synthetic oligonucleotide
gucaggcaagaaggaccua

SEQ ID NO: 2453 - RNA, 19 nt, Artificial Sequence
  Description of Artificial Sequence: Synthetic oligonucleotide
gccugggcgagcugcugca

SEQ ID NO: 2454 - RNA, 19 nt, Artificial Sequence
  Description of Artificial Sequence: Synthetic oligonucleotide
gaugaugcaccggacagga

SEQ ID NO: 2455 - RNA, 19 nt, Artificial Sequence
  Description of Artificial Sequence: Synthetic oligonucleotide
ggaccuguaccuggccaga

SEQ ID NO: 2456 - RNA, 19 nt, Artificial Sequence
  Description of Artificial Sequence: Synthetic oligonucleotide
gcgacgaggaggugcacga

SEQ ID NO: 2457 - RNA, 19 nt, Artificial Sequence
  Description of Artificial Sequence: Synthetic oligonucleotide
ugugguggaggugacccaa

SEQ ID NO: 2458 - RNA, 19 nt, Artificial Sequence
  Description of Artificial Sequence: Synthetic oligonucleotide
uucaagccacacugggaua

SEQ ID NO: 2459 - RNA, 19 nt, Artificial Sequence
  Description of Artificial Sequence: Synthetic oligonucleotide
caagaugguggacaaccga

SEQ ID NO: 2460 - RNA, 19 nt, Artificial Sequence
  Description of Artificial Sequence: Synthetic oligonucleotide
ucaacuuccgcgacaagca

SEQ ID NO: 2461 - RNA, 19 nt, Artificial Sequence
  Description of Artificial Sequence: Synthetic oligonucleotide
auucauugggcgccuggua

SEQ ID NO: 2462 - RNA, 19 nt, Artificial Sequence
  Description of Artificial Sequence: Synthetic oligonucleotide
cuccaagaucaacuuccga

SEQ ID NO: 2463 - RNA, 19 nt, Artificial Sequence
  Description of Artificial Sequence: Synthetic oligonucleotide
caggccauggccaaggaca

SEQ ID NO: 2464 - RNA, 19 nt, Artificial Sequence
  Description of Artificial Sequence: Synthetic oligonucleotide
guaccaggccauggccaaa

SEQ ID NO: 2465 - RNA, 19 nt, Artificial Sequence
  Description of Artificial Sequence: Synthetic oligonucleotide
ugucaggcaagaaggacca

SEQ ID NO: 2466 - RNA, 19 nt, Artificial Sequence
  Description of Artificial Sequence: Synthetic oligonucleotide
cuucgugcgcagcagcaaa

SEQ ID NO: 2467 - RNA, 19 nt, Artificial Sequence
  Description of Artificial Sequence: Synthetic oligonucleotide
caacuuccgcgacaagcga

SEQ ID NO: 2468 - RNA, 19 nt, Artificial Sequence
  Description of Artificial Sequence: Synthetic oligonucleotide
ccaccacaagaugguggaa

SEQ ID NO: 2469 - RNA, 19 nt, Artificial Sequence
  Description of Artificial Sequence: Synthetic oligonucleotide
gcgcgacgaggaggugcaa

SEQ ID NO: 2470 - RNA, 19 nt, Artificial Sequence
  Description of Artificial Sequence: Synthetic oligonucleotide
cuacaacugcgagcacuca

SEQ ID NO: 2471 - RNA, 19 nt, Artificial Sequence
  Description of Artificial Sequence: Synthetic oligonucleotide
uggaggugacccaugacca

SEQ ID NO: 2472 - RNA, 19 nt, Artificial Sequence
  Description of Artificial Sequence: Synthetic oligonucleotide
gaggucaccaaggacguga

SEQ ID NO: 2473 - RNA, 19 nt, Artificial Sequence
  Description of Artificial Sequence: Synthetic oligonucleotide
aagaaggaccuguaccuga

SEQ ID NO: 2474 - RNA, 19 nt, Artificial Sequence
  Description of Artificial Sequence: Synthetic oligonucleotide
gacaaccguggcuucauga

SEQ ID NO: 2475 - RNA, 19 nt, Artificial Sequence
  Description of Artificial Sequence: Synthetic oligonucleotide
accaggacaucuacgggca

SEQ ID NO: 2476 - RNA, 19 nt, Artificial Sequence
  Description of Artificial Sequence: Synthetic oligonucleotide
gcugcccgaggucaccaaa

SEQ ID NO: 2477 - RNA, 19 nt, Artificial Sequence
  Description of Artificial Sequence: Synthetic oligonucleotide
augcagaagaaggcuguua

SEQ ID NO: 2478 - RNA, 19 nt, Artificial Sequence
  Description of Artificial Sequence: Synthetic oligonucleotide
ggccugggcgagcugcuga

SEQ ID NO: 2479 - RNA, 19 nt, Artificial Sequence
  Description of Artificial Sequence: Synthetic oligonucleotide
gaugguggacaaccgugga

SEQ ID NO: 2480 - RNA, 19 nt, Artificial Sequence
  Description of Artificial Sequence: Synthetic oligonucleotide
cucccugcuauucauugga

SEQ ID NO: 2481 - RNA, 19 nt, Artificial Sequence
  Description of Artificial Sequence: Synthetic oligonucleotide
gaaggaccuguaccuggca

SEQ ID NO: 2482 - RNA, 19 nt, Artificial Sequence
  Description of Artificial Sequence: Synthetic oligonucleotide
ccaccgacggcaagcugca

SEQ ID NO: 2483 - RNA, 19 nt, Artificial Sequence
  Description of Artificial Sequence: Synthetic oligonucleotide
ugcuauucauugggcgcca

SEQ ID NO: 2484 - RNA, 19 nt, Artificial Sequence
  Description of Artificial Sequence: Synthetic oligonucleotide
auguucuucaagccacaca

SEQ ID NO: 2485 - RNA, 19 nt, Artificial Sequence
  Description of Artificial Sequence: Synthetic oligonucleotide
ccaggacaucuacgggcga

SEQ ID NO: 2486 - RNA, 19 nt, Artificial Sequence
  Description of Artificial Sequence: Synthetic oligonucleotide
gcgcgaggagcugcgcaga

SEQ ID NO: 2487 - RNA, 19 nt, Artificial Sequence
  Description of Artificial Sequence: Synthetic oligonucleotide
gagcagcugcgcgacgaga

SEQ ID NO: 2488 - RNA, 19 nt, Artificial Sequence
  Description of Artificial Sequence: Synthetic oligonucleotide
cuauucauugggcgccuga

SEQ ID NO: 2489 - RNA, 19 nt, Artificial Sequence
  Description of Artificial Sequence: Synthetic oligonucleotide
acaagcucuccagccucaa

SEQ ID NO: 2490 - RNA, 19 nt, Artificial Sequence
  Description of Artificial Sequence: Synthetic oligonucleotide
gcugaagaucuggauggga

SEQ ID NO: 2491 - RNA, 19 nt, Artificial Sequence
  Description of Artificial Sequence: Synthetic oligonucleotide
gaccaggacaucuacggga

SEQ ID NO: 2492 - RNA, 19 nt, Artificial Sequence
  Description of Artificial Sequence: Synthetic oligonucleotide
caagcgcagcgcgcugcaa

SEQ ID NO: 2493 - RNA, 19 nt, Artificial Sequence
  Description of Artificial Sequence: Synthetic oligonucleotide
ccauggccaaggaccagga

SEQ ID NO: 2494 - RNA, 19 nt, Artificial Sequence
  Description of Artificial Sequence: Synthetic oligonucleotide
caccaaggacguggagcga

SEQ ID NO: 2495 - RNA, 19 nt, Artificial Sequence
  Description of Artificial Sequence: Synthetic oligonucleotide
ccguggcuucauggugaca

SEQ ID NO: 2496 - RNA, 19 nt, Artificial Sequence
  Description of Artificial Sequence: Synthetic oligonucleotide
ugaccaggacaucuacgga

SEQ ID NO: 2497 - RNA, 19 nt, Artificial Sequence
  Description of Artificial Sequence: Synthetic oligonucleotide
agaccaccgacggcaagca

SEQ ID NO: 2498 - RNA, 19 nt, Artificial Sequence
  Description of Artificial Sequence: Synthetic oligonucleotide
gacaagcgcagcgcgcuga

SEQ ID NO: 2499 - RNA, 19 nt, Artificial Sequence
  Description of Artificial Sequence: Synthetic oligonucleotide
agaaacaccuggcugggca

SEQ ID NO: 2500 - RNA, 19 nt, Artificial Sequence
  Description of Artificial Sequence: Synthetic oligonucleotide
aagaugguggacaaccgua

SEQ ID NO: 2501 - RNA, 19 nt, Artificial Sequence
  Description of Artificial Sequence: Synthetic oligonucleotide
cagaccaccgacggcaaga

SEQ ID NO: 2502 - RNA, 19 nt, Artificial Sequence
  Description of Artificial Sequence: Synthetic oligonucleotide
aggaccuguaccuggccaa

SEQ ID NO: 2503 - RNA, 19 nt, Artificial Sequence
  Description of Artificial Sequence: Synthetic oligonucleotide
cugcuauucauugggcgca

SEQ ID NO: 2504 - RNA, 19 nt, Artificial Sequence
  Description of Artificial Sequence: Synthetic oligonucleotide
guccaucaacgagugggca

SEQ ID NO: 2505 - RNA, 19 nt, Artificial Sequence
  Description of Artificial Sequence: Synthetic oligonucleotide
ccaggccauggccaaggaa

SEQ ID NO: 2506 - RNA, 19 nt, Artificial Sequence
  Description of Artificial Sequence: Synthetic oligonucleotide
aagcagcacuacaacugca

SEQ ID NO: 2507 - RNA, 19 nt, Artificial Sequence
  Description of Artificial Sequence: Synthetic oligonucleotide
uguuccacgccaccgccua

SEQ ID NO: 2508 - RNA, 19 nt, Artificial Sequence
  Description of Artificial Sequence: Synthetic oligonucleotide
uacaacuacuacgacgaca

SEQ ID NO: 2509 - RNA, 19 nt, Artificial Sequence
  Description of Artificial Sequence: Synthetic oligonucleotide
ccucaucauccucaugcca

SEQ ID NO: 2510 - RNA, 19 nt, Artificial Sequence
  Description of Artificial Sequence: Synthetic oligonucleotide
ugguggacaaccguggcua

SEQ ID NO: 2511 - RNA, 19 nt, Artificial Sequence
  Description of Artificial Sequence: Synthetic oligonucleotide
gaccaccgacggcaagcua

SEQ ID NO: 2512 - RNA, 19 nt, Artificial Sequence
  Description of Artificial Sequence: Synthetic oligonucleotide
agcugcgcgacgaggagga

SEQ ID NO: 2513 - RNA, 19 nt, Artificial Sequence
  Description of Artificial Sequence: Synthetic oligonucleotide
cggcaagcugcccgaggua

SEQ ID NO: 2514 - RNA, 19 nt, Artificial Sequence
  Description of Artificial Sequence: Synthetic oligonucleotide
uggcccacaagcucuccaa

SEQ ID NO: 2515 - RNA, 19 nt, Artificial Sequence
  Description of Artificial Sequence: Synthetic oligonucleotide
cagcugcgcgacgaggaga

SEQ ID NO: 2516 - RNA, 19 nt, Artificial Sequence
  Description of Artificial Sequence: Synthetic oligonucleotide
cuuccgcgacaagcgcaga

SEQ ID NO: 2517 - RNA, 19 nt, Artificial Sequence
  Description of Artificial Sequence: Synthetic oligonucleotide
ugggccugacugaggccaa

SEQ ID NO: 2518 - RNA, 19 nt, Artificial Sequence
  Description of Artificial Sequence: Synthetic oligonucleotide
gcugcgcgacgaggaggua

SEQ ID NO: 2519 - RNA, 19 nt, Artificial Sequence
  Description of Artificial Sequence: Synthetic oligonucleotide
caggacaucuacgggcgca

SEQ ID NO: 2520 - RNA, 19 nt, Artificial Sequence
  Description of Artificial Sequence: Synthetic oligonucleotide
gccauggccaaggaccaga

SEQ ID NO: 2521 - RNA, 19 nt, Artificial Sequence
  Description of Artificial Sequence: Synthetic oligonucleotide
uccaagaucaacuuccgca

SEQ ID NO: 2522 - RNA, 19 nt, Artificial Sequence
  Description of Artificial Sequence: Synthetic oligonucleotide
accaccgacggcaagcuga

SEQ ID NO: 2523 - RNA, 19 nt, Artificial Sequence
  Description of Artificial Sequence: Synthetic oligonucleotide
aucuacgggcgcgaggaga

SEQ ID NO: 2524 - RNA, 19 nt, Artificial Sequence
  Description of Artificial Sequence: Synthetic oligonucleotide
cugcccgaggucaccaaga

SEQ ID NO: 2525 - RNA, 19 nt, Artificial Sequence
  Description of Artificial Sequence: Synthetic oligonucleotide
aucaacuuccgcgacaaga

SEQ ID NO: 2526 - RNA, 19 nt, Artificial Sequence
  Description of Artificial Sequence: Synthetic oligonucleotide
ucauugggcgccuggucca

SEQ ID NO: 2527 - RNA, 19 nt, Artificial Sequence
  Description of Artificial Sequence: Synthetic oligonucleotide
cauugggcgccugguccga

SEQ ID NO: 2528 - RNA, 19 nt, Artificial Sequence
  Description of Artificial Sequence: Synthetic oligonucleotide
guguuccacgccaccgcca

SEQ ID NO: 2529 - RNA, 19 nt, Artificial Sequence
  Description of Artificial Sequence: Synthetic oligonucleotide
augaugcaccggacaggca

SEQ ID NO: 2530 - RNA, 19 nt, Artificial Sequence
  Description of Artificial Sequence: Synthetic oligonucleotide
cgacgaggaggugcacgca

SEQ ID NO: 2531 - RNA, 19 nt, Artificial Sequence
  Description of Artificial Sequence: Synthetic oligonucleotide
cagaaacaccuggcuggga

SEQ ID NO: 2532 - RNA, 19 nt, Artificial Sequence
  Description of Artificial Sequence: Synthetic oligonucleotide
ugaugcaccggacaggcca

SEQ ID NO: 2533 - RNA, 19 nt, Artificial Sequence
  Description of Artificial Sequence: Synthetic oligonucleotide
aaggcuguugccaucucca

SEQ ID NO: 2534 - RNA, 19 nt, Artificial Sequence
  Description of Artificial Sequence: Synthetic oligonucleotide
augacuucgugcgcagcaa

SEQ ID NO: 2535 - RNA, 19 nt, Artificial Sequence
  Description of Artificial Sequence: Synthetic oligonucleotide
ucaggcaagaaggaccuga

SEQ ID NO: 2536 - RNA, 19 nt, Artificial Sequence
  Description of Artificial Sequence: Synthetic oligonucleotide
cucaucauccucaugccca

SEQ ID NO: 2537 - RNA, 19 nt, Artificial Sequence
  Description of Artificial Sequence: Synthetic oligonucleotide
cgcgacgaggaggugcaca

SEQ ID NO: 2538 - RNA, 19 nt, Artificial Sequence
  Description of Artificial Sequence: Synthetic oligonucleotide
acaaccguggcuucaugga

SEQ ID NO: 2539 - RNA, 19 nt, Artificial Sequence
  Description of Artificial Sequence: Synthetic oligonucleotide
uugaccaggacaucuacga

SEQ ID NO: 2540 - RNA, 19 nt, Artificial Sequence
  Description of Artificial Sequence: Synthetic oligonucleotide
caagcugcccgaggucaca

SEQ ID NO: 2541 - RNA, 19 nt, Artificial Sequence
  Description of Artificial Sequence: Synthetic oligonucleotide
ucccugcuauucauuggga

SEQ ID NO: 2542 - RNA, 19 nt, Artificial Sequence
  Description of Artificial Sequence: Synthetic oligonucleotide
uauucauugggcgccugga

SEQ ID NO: 2543 - RNA, 19 nt, Artificial Sequence
  Description of Artificial Sequence: Synthetic oligonucleotide
cugcgcgacgaggagguga

SEQ ID NO: 2544 - RNA, 19 nt, Artificial Sequence
  Description of Artificial Sequence: Synthetic oligonucleotide
cuacgggcgcgaggagcua

SEQ ID NO: 2545 - RNA, 19 nt, Artificial Sequence
  Description of Artificial Sequence: Synthetic oligonucleotide
cgcgaggagcugcgcagca

SEQ ID NO: 2546 - RNA, 19 nt, Artificial Sequence
  Description of Artificial Sequence: Synthetic oligonucleotide
acaccuggcugggcuggga

SEQ ID NO: 2547 - RNA, 19 nt, Artificial Sequence
  Description of Artificial Sequence: Synthetic oligonucleotide
ucuacgggcgcgaggagca

SEQ ID NO: 2548 - RNA, 19 nt, Artificial Sequence
  Description of Artificial Sequence: Synthetic oligonucleotide
uucuucaagccacacugga

SEQ ID NO: 2549 - RNA, 19 nt, Artificial Sequence
  Description of Artificial Sequence: Synthetic oligonucleotide
ccugggcgagcugcugcga

SEQ ID NO: 2550 - RNA, 19 nt, Artificial Sequence
  Description of Artificial Sequence: Synthetic oligonucleotide
aagaaggcuguugccauca

SEQ ID NO: 2551 - RNA, 19 nt, Artificial Sequence
  Description of Artificial Sequence: Synthetic oligonucleotide
cgacggcaagcugcccgaa

SEQ ID NO: 2552 - RNA, 19 nt, Artificial Sequence
  Description of Artificial Sequence: Synthetic oligonucleotide
gacggcaagcugcccgaga

SEQ ID NO: 2553 - RNA, 19 nt, Artificial Sequence
  Description of Artificial Sequence: Synthetic oligonucleotide
uucauugggcgccugguca

SEQ ID NO: 2554 - RNA, 19 nt, Artificial Sequence
  Description of Artificial Sequence: Synthetic oligonucleotide
aagcgcagcgcgcugcaga

SEQ ID NO: 2555 - RNA, 19 nt, Artificial Sequence
  Description of Artificial Sequence: Synthetic oligonucleotide
ccuggcccacaagcucuca

SEQ ID NO: 2556 - RNA, 19 nt, Artificial Sequence
  Description of Artificial Sequence: Synthetic oligonucleotide
acggcaagcugcccgagga

SEQ ID NO: 2557 - RNA, 19 nt, Artificial Sequence
  Description of Artificial Sequence: Synthetic oligonucleotide
uuugaccaggacaucuaca

SEQ ID NO: 2558 - RNA, 19 nt, Artificial Sequence
  Description of Artificial Sequence: Synthetic oligonucleotide
ugacuucgugcgcagcaga

SEQ ID NO: 2559 - RNA, 19 nt, Artificial Sequence
  Description of Artificial Sequence: Synthetic oligonucleotide
aaggacguggagcgcacga

SEQ ID NO: 2560 - RNA, 19 nt, Artificial Sequence
  Description of Artificial Sequence: Synthetic oligonucleotide
uccaucaacgagugggcca

SEQ ID NO: 2561 - RNA, 19 nt, Artificial Sequence
  Description of Artificial Sequence: Synthetic oligonucleotide
caccgacggcaagcugcca

SEQ ID NO: 2562 - RNA, 19 nt, Artificial Sequence
  Description of Artificial Sequence: Synthetic oligonucleotide
acgggcgcgaggagcugca

SEQ ID NO: 2563 - RNA, 19 nt, Artificial Sequence
  Description of Artificial Sequence: Synthetic oligonucleotide
uccgcgacaagcgcagcga

SEQ ID NO: 2564 - RNA, 19 nt, Artificial Sequence
  Description of Artificial Sequence: Synthetic oligonucleotide
uugggcgccugguccggca

SEQ ID NO: 2565 - RNA, 19 nt, Artificial Sequence
  Description of Artificial Sequence: Synthetic oligonucleotide
augguggacaaccguggca

SEQ ID NO: 2566 - RNA, 19 nt, Artificial Sequence
  Description of Artificial Sequence: Synthetic oligonucleotide
auugggcgccugguccgga

SEQ ID NO: 2567 - RNA, 19 nt, Artificial Sequence
  Description of Artificial Sequence: Synthetic oligonucleotide
uacgggcgcgaggagcuga

SEQ ID NO: 2568 - RNA, 19 nt, Artificial Sequence
  Description of Artificial Sequence: Synthetic oligonucleotide
augcaccggacaggccuca

SEQ ID NO: 2569 - RNA, 19 nt, Artificial Sequence
  Description of Artificial Sequence: Synthetic oligonucleotide
uuccaccacaagaugguga

SEQ ID NO: 2570 - RNA, 19 nt, Artificial Sequence
  Description of Artificial Sequence: Synthetic oligonucleotide
uuccgcgacaagcgcagca

SEQ ID NO: 2571 - RNA, 19 nt, Artificial Sequence
  Description of Artificial Sequence: Synthetic oligonucleotide
uaccaggccauggccaaga

SEQ ID NO: 2572 - RNA, 19 nt, Artificial Sequence
  Description of Artificial Sequence: Synthetic oligonucleotide
aaacaccuggcugggcuga

SEQ ID NO: 2573 - RNA, 19 nt, Artificial Sequence
  Description of Artificial Sequence: Synthetic oligonucleotide
accgacggcaagcugccca

SEQ ID NO: 2574 - RNA, 19 nt, Artificial Sequence
  Description of Artificial Sequence: Synthetic oligonucleotide
aacaccuggcugggcugga

SEQ ID NO: 2575 - RNA, 19 nt, Artificial Sequence
  Description of Artificial Sequence: Synthetic oligonucleotide
uucgugcgcagcagcaaga

SEQ ID NO: 2576 - RNA, 19 nt, Artificial Sequence
  Description of Artificial Sequence: Synthetic oligonucleotide
ugcuccacguccuugguga

SEQ ID NO: 2577 - RNA, 19 nt, Artificial Sequence
  Description of Artificial Sequence: Synthetic oligonucleotide
uauggacugcagcgcgcug

SEQ ID NO: 2578 - RNA, 19 nt, Artificial Sequence
  Description of Artificial Sequence: Synthetic oligonucleotide
uuccucgcgcccguagaug

SEQ ID NO: 2579 - RNA, 19 nt, Artificial Sequence
  Description of Artificial Sequence: Synthetic oligonucleotide
uaggaugaugaggcuggag

SEQ ID NO: 2580 - RNA, 19 nt, Artificial Sequence
  Description of Artificial Sequence: Synthetic oligonucleotide
ucucgcgcccguagauguc

SEQ ID NO: 2581 - RNA, 19 nt, Artificial Sequence
  Description of Artificial Sequence: Synthetic oligonucleotide
uugcuugcugcugcgcacg

SEQ ID NO: 2582 - RNA, 19 nt, Artificial Sequence
  Description of Artificial Sequence: Synthetic oligonucleotide
ucuccacguccuuggugac

SEQ ID NO: 2583 - RNA, 19 nt, Artificial Sequence
  Description of Artificial Sequence: Synthetic oligonucleotide
ugcgcugcgcuugucgcgg

SEQ ID NO: 2584 - RNA, 19 nt, Artificial Sequence
  Description of Artificial Sequence: Synthetic oligonucleotide
ugacugcagcgcgcugcgc

SEQ ID NO: 2585 - RNA, 19 nt, Artificial Sequence
  Description of Artificial Sequence: Synthetic oligonucleotide
ucuggagagcuugugggcc

SEQ ID NO: 2586 - RNA, 19 nt, Artificial Sequence
  Description of Artificial Sequence: Synthetic oligonucleotide
ugugcgcuccacguccuug

SEQ ID NO: 2587 - RNA, 19 nt, Artificial Sequence
  Description of Artificial Sequence: Synthetic oligonucleotide
ucaugaggaugaugaggcu

SEQ ID NO: 2588 - RNA, 19 nt, Artificial Sequence
  Description of Artificial Sequence: Synthetic oligonucleotide
uggucaccuccaccacacc

SEQ ID NO: 2589 - RNA, 19 nt, Artificial Sequence
  Description of Artificial Sequence: Synthetic oligonucleotide
uugaccucgggcagcuugc

SEQ ID NO: 2590 - RNA, 19 nt, Artificial Sequence
  Description of Artificial Sequence: Synthetic oligonucleotide
ugucaugggucaccuccac

SEQ ID NO: 2591 - RNA, 19 nt, Artificial Sequence
  Description of Artificial Sequence: Synthetic oligonucleotide
uguuguccaccaucuugug

SEQ ID NO: 2592 - RNA, 19 nt, Artificial Sequence
  Description of Artificial Sequence: Synthetic oligonucleotide
uggcugcgcagcuccucgc

SEQ ID NO: 2593 - RNA, 19 nt, Artificial Sequence
  Description of Artificial Sequence: Synthetic oligonucleotide
ucuucucgucgucguagua

SEQ ID NO: 2594 - RNA, 19 nt, Artificial Sequence
  Description of Artificial Sequence: Synthetic oligonucleotide
ucaggucaugggucaccuc

SEQ ID NO: 2595 - RNA, 19 nt, Artificial Sequence
  Description of Artificial Sequence: Synthetic oligonucleotide
uugcgcuugucgcggaagu

SEQ ID NO: 2596 - RNA, 19 nt, Artificial Sequence
  Description of Artificial Sequence: Synthetic oligonucleotide
ugcuggagagcuugugggc

SEQ ID NO: 2597 - RNA, 19 nt, Artificial Sequence
  Description of Artificial Sequence: Synthetic oligonucleotide
uugcugcuugcugcugcgc

SEQ ID NO: 2598 - RNA, 19 nt, Artificial Sequence
  Description of Artificial Sequence: Synthetic oligonucleotide
ugggcugcgcagcuccucg

SEQ ID NO: 2599 - RNA, 19 nt, Artificial Sequence
  Description of Artificial Sequence: Synthetic oligonucleotide
ucuugaagaacauggcguu

SEQ ID NO: 2600 - RNA, 19 nt, Artificial Sequence
  Description of Artificial Sequence: Synthetic oligonucleotide
uagguccuucuugccugac

SEQ ID NO: 2601 - RNA, 19 nt, Artificial Sequence
  Description of Artificial Sequence: Synthetic oligonucleotide
ugcagcagcucgcccaggc

SEQ ID NO: 2602 - RNA, 19 nt, Artificial Sequence
  Description of Artificial Sequence: Synthetic oligonucleotide
uccuguccggugcaucauc

SEQ ID NO: 2603 - RNA, 19 nt, Artificial Sequence
  Description of Artificial Sequence: Synthetic oligonucleotide
ucuggccagguacaggucc

SEQ ID NO: 2604 - RNA, 19 nt, Artificial Sequence
  Description of Artificial Sequence: Synthetic oligonucleotide
ucgugcaccuccucgucgc

SEQ ID NO: 2605 - RNA, 19 nt, Artificial Sequence
  Description of Artificial Sequence: Synthetic oligonucleotide
uugggucaccuccaccaca

SEQ ID NO: 2606 - RNA, 19 nt, Artificial Sequence
  Description of Artificial Sequence: Synthetic oligonucleotide
uaucccaguguggcuugaa

SEQ ID NO: 2607 - RNA, 19 nt, Artificial Sequence
  Description of Artificial Sequence: Synthetic oligonucleotide
ucgguuguccaccaucuug

SEQ ID NO: 2608 - RNA, 19 nt, Artificial Sequence
  Description of Artificial Sequence: Synthetic oligonucleotide
ugcuugucgcggaaguuga

SEQ ID NO: 2609 - RNA, 19 nt, Artificial Sequence
  Description of Artificial Sequence: Synthetic oligonucleotide
uaccaggcgcccaaugaau

SEQ ID NO: 2610 - RNA, 19 nt, Artificial Sequence
  Description of Artificial Sequence: Synthetic oligonucleotide
ucggaaguugaucuuggag

SEQ ID NO: 2611 - RNA, 19 nt, Artificial Sequence
  Description of Artificial Sequence: Synthetic oligonucleotide
uguccuuggccauggccug

SEQ ID NO: 2612 - RNA, 19 nt, Artificial Sequence
  Description of Artificial Sequence: Synthetic oligonucleotide
uuuggccauggccugguac

SEQ ID NO: 2613 - RNA, 19 nt, Artificial Sequence
  Description of Artificial Sequence: Synthetic oligonucleotide
ugguccuucuugccugaca

SEQ ID NO: 2614 - RNA, 19 nt, Artificial Sequence
  Description of Artificial Sequence: Synthetic oligonucleotide
uuugcugcugcgcacgaag

SEQ ID NO: 2615 - RNA, 19 nt, Artificial Sequence
  Description of Artificial Sequence: Synthetic oligonucleotide
ucgcuugucgcggaaguug

SEQ ID NO: 2616 - RNA, 19 nt, Artificial Sequence
  Description of Artificial Sequence: Synthetic oligonucleotide
uuccaccaucuuguggugg

SEQ ID NO: 2617 - RNA, 19 nt, Artificial Sequence
  Description of Artificial Sequence: Synthetic oligonucleotide
uugcaccuccucgucgcgc

SEQ ID NO: 2618 - RNA, 19 nt, Artificial Sequence
  Description of Artificial Sequence: Synthetic oligonucleotide
ugagugcucgcaguuguag

SEQ ID NO: 2619 - RNA, 19 nt, Artificial Sequence
  Description of Artificial Sequence: Synthetic oligonucleotide
uggucaugggucaccucca

SEQ ID NO: 2620 - RNA, 19 nt, Artificial Sequence
  Description of Artificial Sequence: Synthetic oligonucleotide
ucacguccuuggugaccuc

SEQ ID NO: 2621 - RNA, 19 nt, Artificial Sequence
  Description of Artificial Sequence: Synthetic oligonucleotide
ucagguacagguccuucuu

SEQ ID NO: 2622 - RNA, 19 nt, Artificial Sequence
  Description of Artificial Sequence: Synthetic oligonucleotide
ucaugaagccacgguuguc

SEQ ID NO: 2623 - RNA, 19 nt, Artificial Sequence
  Description of Artificial Sequence: Synthetic oligonucleotide
ugcccguagauguccuggu

SEQ ID NO: 2624 - RNA, 19 nt, Artificial Sequence
  Description of Artificial Sequence: Synthetic oligonucleotide
uuuggugaccucgggcagc

SEQ ID NO: 2625 - RNA, 19 nt, Artificial Sequence
  Description of Artificial Sequence: Synthetic oligonucleotide
uaacagccuucuucugcau

SEQ ID NO: 2626 - RNA, 19 nt, Artificial Sequence
  Description of Artificial Sequence: Synthetic oligonucleotide
ucagcagcucgcccaggcc

SEQ ID NO: 2627 - RNA, 19 nt, Artificial Sequence
  Description of Artificial Sequence: Synthetic oligonucleotide
uccacgguuguccaccauc

SEQ ID NO: 2628 - RNA, 19 nt, Artificial Sequence
  Description of Artificial Sequence: Synthetic oligonucleotide
uccaaugaauagcagggag

SEQ ID NO: 2629 - RNA, 19 nt, Artificial Sequence
  Description of Artificial Sequence: Synthetic oligonucleotide
ugccagguacagguccuuc

SEQ ID NO: 2630 - RNA, 19 nt, Artificial Sequence
  Description of Artificial Sequence: Synthetic oligonucleotide
ugcagcuugccgucggugg

SEQ ID NO: 2631 - RNA, 19 nt, Artificial Sequence
  Description of Artificial Sequence: Synthetic oligonucleotide
uggcgcccaaugaauagca

SEQ ID NO: 2632 - RNA, 19 nt, Artificial Sequence
  Description of Artificial Sequence: Synthetic oligonucleotide
uguguggcuugaagaacau

SEQ ID NO: 2633 - RNA, 19 nt, Artificial Sequence
  Description of Artificial Sequence: Synthetic oligonucleotide
ucgcccguagauguccugg

SEQ ID NO: 2634 - RNA, 19 nt, Artificial Sequence
  Description of Artificial Sequence: Synthetic oligonucleotide
ucugcgcagcuccucgcgc

SEQ ID NO: 2635 - RNA, 19 nt, Artificial Sequence
  Description of Artificial Sequence: Synthetic oligonucleotide
ucucgucgcgcagcugcuc

SEQ ID NO: 2636 - RNA, 19 nt, Artificial Sequence
  Description of Artificial Sequence: Synthetic oligonucleotide
ucaggcgcccaaugaauag

SEQ ID NO: 2637 - RNA, 19 nt, Artificial Sequence
  Description of Artificial Sequence: Synthetic oligonucleotide
uugaggcuggagagcuugu

SEQ ID NO: 2638 - RNA, 19 nt, Artificial Sequence
  Description of Artificial Sequence: Synthetic oligonucleotide
ucccauccagaucuucagc

SEQ ID NO: 2639 - RNA, 19 nt, Artificial Sequence
  Description of Artificial Sequence: Synthetic oligonucleotide
ucccguagauguccugguc

SEQ ID NO: 2640 - RNA, 19 nt, Artificial Sequence
  Description of Artificial Sequence: Synthetic oligonucleotide
uugcagcgcgcugcgcuug

SEQ ID NO: 2641 - RNA, 19 nt, Artificial Sequence
  Description of Artificial Sequence: Synthetic oligonucleotide
uccugguccuuggccaugg

SEQ ID NO: 2642 - RNA, 19 nt, Artificial Sequence
  Description of Artificial Sequence: Synthetic oligonucleotide
ucgcuccacguccuuggug

SEQ ID NO: 2643 - RNA, 19 nt, Artificial Sequence
  Description of Artificial Sequence: Synthetic oligonucleotide
ugucaccaugaagccacgg

SEQ ID NO: 2644 - RNA, 19 nt, Artificial Sequence
  Description of Artificial Sequence: Synthetic oligonucleotide
uccguagauguccugguca

SEQ ID NO: 2645 - RNA, 19 nt, Artificial Sequence
  Description of Artificial Sequence: Synthetic oligonucleotide
ugcuugccgucgguggucu

SEQ ID NO: 2646 - RNA, 19 nt, Artificial Sequence
  Description of Artificial Sequence: Synthetic oligonucleotide
ucagcgcgcugcgcuuguc

SEQ ID NO: 2647 - RNA, 19 nt, Artificial Sequence
  Description of Artificial Sequence: Synthetic oligonucleotide
ugcccagccagguguuucu

SEQ ID NO: 2648 - RNA, 19 nt, Artificial Sequence
  Description of Artificial Sequence: Synthetic oligonucleotide
uacgguuguccaccaucuu

SEQ ID NO: 2649 - RNA, 19 nt, Artificial Sequence
  Description of Artificial Sequence: Synthetic oligonucleotide
ucuugccgucgguggucug

SEQ ID NO: 2650 - RNA, 19 nt, Artificial Sequence
  Description of Artificial Sequence: Synthetic oligonucleotide
uuggccagguacagguccu

SEQ ID NO: 2651 - RNA, 19 nt, Artificial Sequence
  Description of Artificial Sequence: Synthetic oligonucleotide
ugcgcccaaugaauagcag

SEQ ID NO: 2652 - RNA, 19 nt, Artificial Sequence
  Description of Artificial Sequence: Synthetic oligonucleotide
ugcccacucguugauggac

SEQ ID NO: 2653 - RNA, 19 nt, Artificial Sequence
  Description of Artificial Sequence: Synthetic oligonucleotide
uuccuuggccauggccugg

SEQ ID NO: 2654 - RNA, 19 nt, Artificial Sequence
  Description of Artificial Sequence: Synthetic oligonucleotide
ugcaguuguagugcugcuu

SEQ ID NO: 2655 - RNA, 19 nt, Artificial Sequence
  Description of Artificial Sequence: Synthetic oligonucleotide
uaggcgguggcguggaaca

SEQ ID NO: 2656 - RNA, 19 nt, Artificial Sequence
  Description of Artificial Sequence: Synthetic oligonucleotide
ugucgucguaguaguugua

SEQ ID NO: 2657 - RNA, 19 nt, Artificial Sequence
  Description of Artificial Sequence: Synthetic oligonucleotide
uggcaugaggaugaugagg

SEQ ID NO: 2658 - RNA, 19 nt, Artificial Sequence
  Description of Artificial Sequence: Synthetic oligonucleotide
uagccacgguuguccacca

SEQ ID NO: 2659 - RNA, 19 nt, Artificial Sequence
  Description of Artificial Sequence: Synthetic oligonucleotide
uagcuugccgucggugguc

SEQ ID NO: 2660 - RNA, 19 nt, Artificial Sequence
  Description of Artificial Sequence: Synthetic oligonucleotide
uccuccucgucgcgcagcu

SEQ ID NO: 2661 - RNA, 19 nt, Artificial Sequence
  Description of Artificial Sequence: Synthetic oligonucleotide
uaccucgggcagcuugccg

SEQ ID NO: 2662 - RNA, 19 nt, Artificial Sequence
  Description of Artificial Sequence: Synthetic oligonucleotide
uuggagagcuugugggcca

SEQ ID NO: 2663 - RNA, 19 nt, Artificial Sequence
  Description of Artificial Sequence: Synthetic oligonucleotide
ucuccucgucgcgcagcug

SEQ ID NO: 2664 - RNA, 19 nt, Artificial Sequence
  Description of Artificial Sequence: Synthetic oligonucleotide
ucugcgcuugucgcggaag

SEQ ID NO: 2665 - RNA, 19 nt, Artificial Sequence
  Description of Artificial Sequence: Synthetic oligonucleotide
uuggccucagucaggccca

SEQ ID NO: 2666 - RNA, 19 nt, Artificial Sequence
  Description of Artificial Sequence: Synthetic oligonucleotide
uaccuccucgucgcgcagc

SEQ ID NO: 2667 - RNA, 19 nt, Artificial Sequence
  Description of Artificial Sequence: Synthetic oligonucleotide
ugcgcccguagauguccug

SEQ ID NO: 2668 - RNA, 19 nt, Artificial Sequence
  Description of Artificial Sequence: Synthetic oligonucleotide
ucugguccuuggccauggc

SEQ ID NO: 2669 - RNA, 19 nt, Artificial Sequence
  Description of Artificial Sequence: Synthetic oligonucleotide
ugcggaaguugaucuugga

SEQ ID NO: 2670 - RNA, 19 nt, Artificial Sequence
  Description of Artificial Sequence: Synthetic oligonucleotide
ucagcuugccgucgguggu

SEQ ID NO: 2671 - RNA, 19 nt, Artificial Sequence
  Description of Artificial Sequence: Synthetic oligonucleotide
ucuccucgcgcccguagau

SEQ ID NO: 2672 - RNA, 19 nt, Artificial Sequence
  Description of Artificial Sequence: Synthetic oligonucleotide
ucuuggugaccucgggcag

SEQ ID NO: 2673 - RNA, 19 nt, Artificial Sequence
  Description of Artificial Sequence: Synthetic oligonucleotide
ucuugucgcggaaguugau

SEQ ID NO: 2674 - RNA, 19 nt, Artificial Sequence
  Description of Artificial Sequence: Synthetic oligonucleotide
uggaccaggcgcccaauga

SEQ ID NO: 2675 - RNA, 19 nt, Artificial Sequence
  Description of Artificial Sequence: Synthetic oligonucleotide
ucggaccaggcgcccaaug

SEQ ID NO: 2676 - RNA, 19 nt, Artificial Sequence
  Description of Artificial Sequence: Synthetic oligonucleotide
uggcgguggcguggaacac

SEQ ID NO: 2677 - RNA, 19 nt, Artificial Sequence
  Description of Artificial Sequence: Synthetic oligonucleotide
ugccuguccggugcaucau

SEQ ID NO: 2678 - RNA, 19 nt, Artificial Sequence
  Description of Artificial Sequence: Synthetic oligonucleotide
ugcgugcaccuccucgucg

SEQ ID NO: 2679 - RNA, 19 nt, Artificial Sequence
  Description of Artificial Sequence: Synthetic oligonucleotide
ucccagccagguguuucug

SEQ ID NO: 2680 - RNA, 19 nt, Artificial Sequence
  Description of Artificial Sequence: Synthetic oligonucleotide
uggccuguccggugcauca

SEQ ID NO: 2681 - RNA, 19 nt, Artificial Sequence
  Description of Artificial Sequence: Synthetic oligonucleotide
uggagauggcaacagccuu

SEQ ID NO: 2682 - RNA, 19 nt, Artificial Sequence
  Description of Artificial Sequence: Synthetic oligonucleotide
uugcugcgcacgaagucau

SEQ ID NO: 2683 - RNA, 19 nt, Artificial Sequence
  Description of Artificial Sequence: Synthetic oligonucleotide
ucagguccuucuugccuga

SEQ ID NO: 2684 - RNA, 19 nt, Artificial Sequence
  Description of Artificial Sequence: Synthetic oligonucleotide
ugggcaugaggaugaugag

SEQ ID NO: 2685 - RNA, 19 nt, Artificial Sequence
  Description of Artificial Sequence: Synthetic oligonucleotide
ugugcaccuccucgucgcg

SEQ ID NO: 2686 - RNA, 19 nt, Artificial Sequence
  Description of Artificial Sequence: Synthetic oligonucleotide
uccaugaagccacgguugu

SEQ ID NO: 2687 - RNA, 19 nt, Artificial Sequence
  Description of Artificial Sequence: Synthetic oligonucleotide
ucguagauguccuggucaa

SEQ ID NO: 2688 - RNA, 19 nt, Artificial Sequence
  Description of Artificial Sequence: Synthetic oligonucleotide
ugugaccucgggcagcuug

SEQ ID NO: 2689 - RNA, 19 nt, Artificial Sequence
  Description of Artificial Sequence: Synthetic oligonucleotide
ucccaaugaauagcaggga

SEQ ID NO: 2690 - RNA, 19 nt, Artificial Sequence
  Description of Artificial Sequence: Synthetic oligonucleotide
uccaggcgcccaaugaaua

SEQ ID NO: 2691 - RNA, 19 nt, Artificial Sequence
  Description of Artificial Sequence: Synthetic oligonucleotide
ucaccuccucgucgcgcag

SEQ ID NO: 2692 - RNA, 19 nt, Artificial Sequence
  Description of Artificial Sequence: Synthetic oligonucleotide
uagcuccucgcgcccguag

SEQ ID NO: 2693 - RNA, 19 nt, Artificial Sequence
  Description of Artificial Sequence: Synthetic oligonucleotide
ugcugcgcagcuccucgcg

SEQ ID NO: 2694 - RNA, 19 nt, Artificial Sequence
  Description of Artificial Sequence: Synthetic oligonucleotide
ucccagcccagccaggugu

SEQ ID NO: 2695 - RNA, 19 nt, Artificial Sequence
  Description of Artificial Sequence: Synthetic oligonucleotide
ugcuccucgcgcccguaga

SEQ ID NO: 2696 - RNA, 19 nt, Artificial Sequence
  Description of Artificial Sequence: Synthetic oligonucleotide
uccaguguggcuugaagaa

SEQ ID NO: 2697 - RNA, 19 nt, Artificial Sequence
  Description of Artificial Sequence: Synthetic oligonucleotide
ucgcagcagcucgcccagg

SEQ ID NO: 2698 - RNA, 19 nt, Artificial Sequence
  Description of Artificial Sequence: Synthetic oligonucleotide
ugauggcaacagccuucuu

SEQ ID NO: 2699 - RNA, 19 nt, Artificial Sequence
  Description of Artificial Sequence: Synthetic oligonucleotide
uucgggcagcuugccgucg

SEQ ID NO: 2700 - RNA, 19 nt, Artificial Sequence
  Description of Artificial Sequence: Synthetic oligonucleotide
ucucgggcagcuugccguc

SEQ ID NO: 2701 - RNA, 19 nt, Artificial Sequence
  Description of Artificial Sequence: Synthetic oligonucleotide
ugaccaggcgcccaaugaa

SEQ ID NO: 2702 - RNA, 19 nt, Artificial Sequence
  Description of Artificial Sequence: Synthetic oligonucleotide
ucugcagcgcgcugcgcuu

SEQ ID NO: 2703 - RNA, 19 nt, Artificial Sequence
  Description of Artificial Sequence: Synthetic oligonucleotide
ugagagcuugugggccagg

SEQ ID NO: 2704 - RNA, 19 nt, Artificial Sequence
  Description of Artificial Sequence: Synthetic oligonucleotide
uccucgggcagcuugccgu

SEQ ID NO: 2705 - RNA, 19 nt, Artificial Sequence
  Description of Artificial Sequence: Synthetic oligonucleotide
uguagauguccuggucaaa

SEQ ID NO: 2706 - RNA, 19 nt, Artificial Sequence
  Description of Artificial Sequence: Synthetic oligonucleotide
ucugcugcgcacgaaguca

SEQ ID NO: 2707 - RNA, 19 nt, Artificial Sequence
  Description of Artificial Sequence: Synthetic oligonucleotide
ucgugcgcuccacguccuu

SEQ ID NO: 2708 - RNA, 19 nt, Artificial Sequence
  Description of Artificial Sequence: Synthetic oligonucleotide
uggcccacucguugaugga

SEQ ID NO: 2709 - RNA, 19 nt, Artificial Sequence
  Description of Artificial Sequence: Synthetic oligonucleotide
uggcagcuugccgucggug

SEQ ID NO: 2710 - RNA, 19 nt, Artificial Sequence
  Description of Artificial Sequence: Synthetic oligonucleotide
ugcagcuccucgcgcccgu

SEQ ID NO: 2711 - RNA, 19 nt, Artificial Sequence
  Description of Artificial Sequence: Synthetic oligonucleotide
ucgcugcgcuugucgcgga

SEQ ID NO: 2712 - RNA, 19 nt, Artificial Sequence
  Description of Artificial Sequence: Synthetic oligonucleotide
ugccggaccaggcgcccaa

SEQ ID NO: 2713 - RNA, 19 nt, Artificial Sequence
  Description of Artificial Sequence: Synthetic oligonucleotide
ugccacgguuguccaccau

SEQ ID NO: 2714 - RNA, 19 nt, Artificial Sequence
  Description of Artificial Sequence: Synthetic oligonucleotide
uccggaccaggcgcccaau

SEQ ID NO: 2715 - RNA, 19 nt, Artificial Sequence
  Description of Artificial Sequence: Synthetic oligonucleotide
ucagcuccucgcgcccgua

SEQ ID NO: 2716 - RNA, 19 nt, Artificial Sequence
  Description of Artificial Sequence: Synthetic oligonucleotide
ugaggccuguccggugcau

SEQ ID NO: 2717 - RNA, 19 nt, Artificial Sequence
  Description of Artificial Sequence: Synthetic oligonucleotide
ucaccaucuugugguggaa

SEQ ID NO: 2718 - RNA, 19 nt, Artificial Sequence
  Description of Artificial Sequence: Synthetic oligonucleotide
ugcugcgcuugucgcggaa

SEQ ID NO: 2719 - RNA, 19 nt, Artificial Sequence
  Description of Artificial Sequence: Synthetic oligonucleotide
ucuuggccauggccuggua

SEQ ID NO: 2720 - RNA, 19 nt, Artificial Sequence
  Description of Artificial Sequence: Synthetic oligonucleotide
ucagcccagccagguguuu

SEQ ID NO: 2721 - RNA, 19 nt, Artificial Sequence
  Description of Artificial Sequence: Synthetic oligonucleotide
ugggcagcuugccgucggu

SEQ ID NO: 2722 - RNA, 19 nt, Artificial Sequence
  Description of Artificial Sequence: Synthetic oligonucleotide
uccagcccagccagguguu

SEQ ID NO: 2723 - RNA, 19 nt, Artificial Sequence
  Description of Artificial Sequence: Synthetic oligonucleotide
ucuugcugcugcgcacgaa

SEQ ID NO: 2724 - RNA, 27 nt, Artificial Sequence
  Description of Artificial Sequence: Synthetic oligonucleotide
ucgucguaguaguuguagaggccuguu

SEQ ID NO: 2725 - RNA, 27 nt, Artificial Sequence
  Description of Artificial Sequence: Synthetic oligonucleotide
cgcggaaguugaucuuggagugcucuu

SEQ ID NO: 2726 - RNA, 27 nt, Artificial Sequence
  Description of Artificial Sequence: Synthetic oligonucleotide
cucggaaguugaucuuggaguguucuu

SEQ ID NO: 2727 - DNA, 21 bp, Artificial Sequence
  Description of Artificial Sequence: Synthetic oligonucleotide
ctgaggccattgacaagaatt

SEQ ID NO: 2728 - DNA, 25 bp, Artificial Sequence
  Description of Artificial Sequence: Synthetic oligonucleotide
ctgaggccattgacaagaacaaggc

SEQ ID NO: 2729 - RNA, 27 nt, Artificial Sequence
  Description of Artificial Sequence: Synthetic oligonucleotide
cagcuuuuccuucucgucgucguaguu

SEQ ID NO: 2730 - RNA, 25 nt, Artificial Sequence
  Description of Artificial Sequence: Synthetic oligonucleotide
guuccaccauaagaugguagacaac

SEQ ID NO: 2731 - RNA, 25 nt, Artificial Sequence
  Description of Artificial Sequence: Synthetic oligonucleotide
ccacaaguuuuauauccaaucuagc

SEQ ID NO: 2732 - RNA, 19 nt, Artificial Sequence
  Description of Artificial Sequence: Synthetic oligonucleotide
gaaaccuguagaggccgca

SEQ ID NO: 2733 - RNA, 46 nt, Artificial Sequence
  Description of Artificial Sequence: Synthetic oligonucleotide
  modified_base (2)..(9): a, c, u, g, unknown or other
  modified_base (20)..(27): a, c, u, g, unknown or other
snnnnnnnnwwwwwwwwwwnnnnnnnnwwwwwwwwwwwwwwwwwww

SEQ ID NO: 2734 - RNA, 19 nt, Artificial Sequence
  Description of Artificial Sequence: Synthetic oligonucleotide
gagacacaugggugcuaua

SEQ ID NO: 2735 - RNA, 19 nt, Artificial Sequence
  Description of Artificial Sequence: Synthetic oligonucleotide
uauagcacccaugugucuc

SEQ ID NO: 2736 - RNA, 19 nt, Artificial Sequence
  Description of Artificial Sequence: Synthetic oligonucleotide
acaagaugcgagacgagua

SEQ ID NO: 2737 - RNA, 19 nt, Artificial Sequence
  Description of Artificial Sequence: Synthetic oligonucleotide
uacucgucucgcaucuugu

SEQ ID NO: 2738 - RNA, 19 nt, Artificial Sequence
  Description of Artificial Sequence: Synthetic oligonucleotide
acuccaagaucaacuuccu

SEQ ID NO: 2739 - RNA, 19 nt, Artificial Sequence
  Description of Artificial Sequence: Synthetic oligonucleotide
aggaaguugaucuuggagu

SEQ ID NO: 2740 - RNA, 19 nt, Artificial Sequence
  Description of Artificial Sequence: Synthetic oligonucleotide
uccugagacacauggguga

SEQ ID NO: 2741 - RNA, 19 nt, Artificial Sequence
  Description of Artificial Sequence: Synthetic oligonucleotide
ucacccaugugucucagga

SEQ ID NO: 2742 - RNA, 19 nt, Artificial Sequence
  Description of Artificial Sequence: Synthetic oligonucleotide
uccugagacacaugggugu

SEQ ID NO: 2743 - RNA, 19 nt, Artificial Sequence
  Description of Artificial Sequence: Synthetic oligonucleotide
acacccaugugucucagga

SEQ ID NO: 2744 - RNA, 19 nt, Artificial Sequence
  Description of Artificial Sequence: Synthetic oligonucleotide
gagacacaugggugcuauu

SEQ ID NO: 2745 - RNA, 19 nt, Artificial Sequence
  Description of Artificial Sequence: Synthetic oligonucleotide
aauagcacccaugugucuc

SEQ ID NO: 2746 - RNA, 19 nt, Artificial Sequence
  Description of Artificial Sequence: Synthetic oligonucleotide
acaagaugcgagacgaguu

SEQ ID NO: 2747 - RNA, 19 nt, Artificial Sequence
  Description of Artificial Sequence: Synthetic oligonucleotide
aacucgucucgcaucuugu

SEQ ID NO: 2748 - RNA, 19 nt, Artificial Sequence
  Description of Artificial Sequence: Synthetic oligonucleotide
gagacacaugggugcuaua

SEQ ID NO: 2749 - RNA, 19 nt, Artificial Sequence
  Description of Artificial Sequence: Synthetic oligonucleotide
uauagcacccaugugucuc

---

What is claimed:

1. A pharmaceutical composition comprising a drug carrier and a double-stranded nucleic acid molecule, wherein the drug carrier comprises a lipid and a compound for facilitating drug delivery to a target cell, consisting of the structure (retinoid)$_m$-linker-(retinoid)$_n$, wherein m and n are independently 0, 1, 2, or 3, except that m and n are not both zero; and wherein the double-stranded nucleic acid molecule is a modified nucleic acid molecule having the structure (A2) set forth below 5' N1-(N)x-Z 3' (antisense strand)

3' Z'—N2-(N')y-z" 5' (sense strand)     (A2)

wherein each of N2 and N' is an unmodified or modified ribonucleotide, or an unconventional moiety;

wherein each of (N)x and (N')y is an oligonucleotide in which each consecutive N or N' is joined to the adjacent N or N' by a covalent bond, and wherein (N)$_x$ comprises at least one modified ribonucleotide among a multiplicity of unmodified or modified ribonucleotides, or unconventional moieties, N;

wherein each of x and y is independently an integer between 17 and 39;

wherein the sequence of (N')y has complementarity to the sequence of (N)x and (N)x has complementarity to a consecutive sequence in a target RNA;

wherein N1 is covalently bound to (N)x and is mismatched to the target RNA or is a complementary DNA moiety to the target RNA;

wherein N2 is covalently bound to (N')y and forms a base pair with N1;

wherein N1 is a moiety selected from the group consisting of natural or modified uridine, deoxyribouridine, ribothymidine, deoxyribothymidine, adenosine or deoxyadenosine;

wherein z" may be present or absent, but if present is a capping moiety covalently attached at the 5'-terminus of N2-(N')y;

wherein each of Z and Z' is independently present or absent, but if present is independently 1-5 consecutive nucleotides, consecutive non-nucleotide moieties or a combination thereof covalently attached at the 3'-terminus of the strand in which it is present; and wherein (N)x comprises an antisense sequence to the mRNA coding sequence for human hsp47 exemplified by SEQ ID NO:1.

2. The pharmaceutical composition of 1, wherein the retinoid is selected from vitamin A, retinoic acid, tretinoin, adapalene, 4-hydroxy(phenyl)retinamide (4-HPR), retinyl palmitate, retinal, saturated retinoic acid, and saturated, demethylated retinoic acid.

3. The pharmaceutical composition of claim 1, wherein the linker comprises a bond, a polyethylene glycol (PEG) or PEG-like molecule.

4. The pharmaceutical composition of claim 1, wherein the linker is selected from a bond, bis-amido-PEG, tris-amido-PEG, tetra-amido-PEG, Lys-bis-amido-PEG Lys, Lys-tris-amido-PEG-Lys, Lys-tetra-amido-PEG-Lys, Lys-PEG-Lys, PEG2000, PEG1250, PEG1000, PEG750, PEG550, PEG-Glu, Glu, hexyl, Gly3, and 4-aminobutanoate (GluNH).

5. The pharmaceutical composition of claim 1, wherein the compound is selected from retinoid-PEG-retinoid, (retinoid)$_2$-PEG-(retinoid)$_2$, VA-PEG2000-VA, (retinoid)$_2$-bis-amido-PEG-(retinoid)$_2$, and (retinoid)$_2$-Lys-bis-amido-PEG-Lys-(retinoid)$_2$.

6. The pharmaceutical composition of 5, wherein the retinoid is selected from vitamin A, retinoic acid, tretinoin, adapalene, 4-hydroxy(phenyl)retinamide (4-HPR), retinyl palmitate, retinal, saturated retinoic acid, and saturated, demethylated retinoic acid.

7. The pharmaceutical composition of claim 6, wherein the compound has the structure of formula

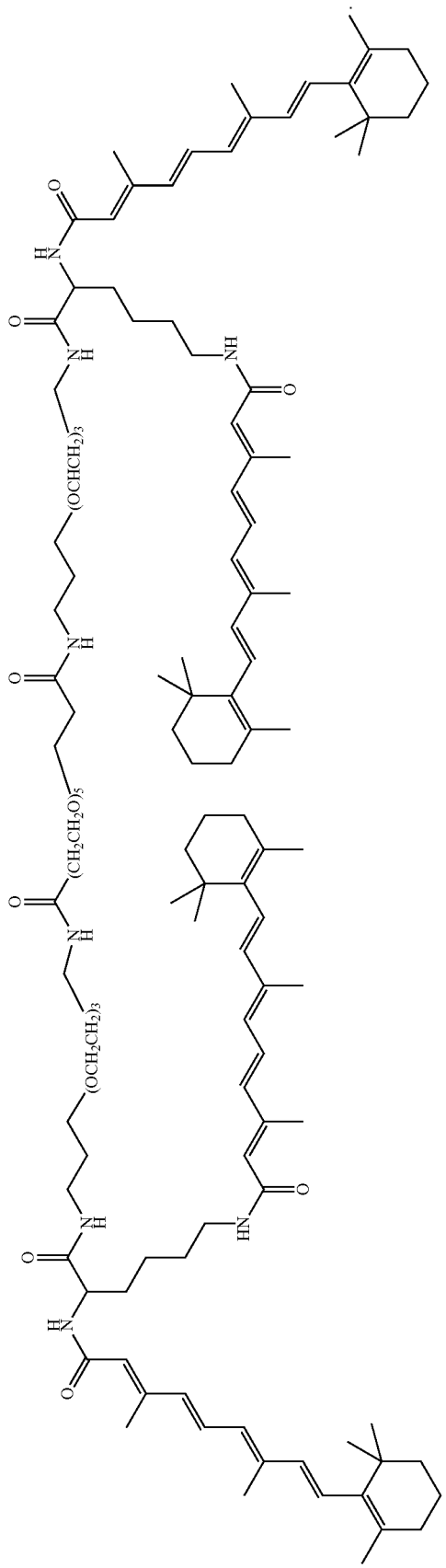

wherein q, r, and s are each independently 1, 2, 3, 4, 5, 6, 7, 8, 9, or 10.

8. The pharmaceutical composition of claim 6, wherein the compound has the structure of formula

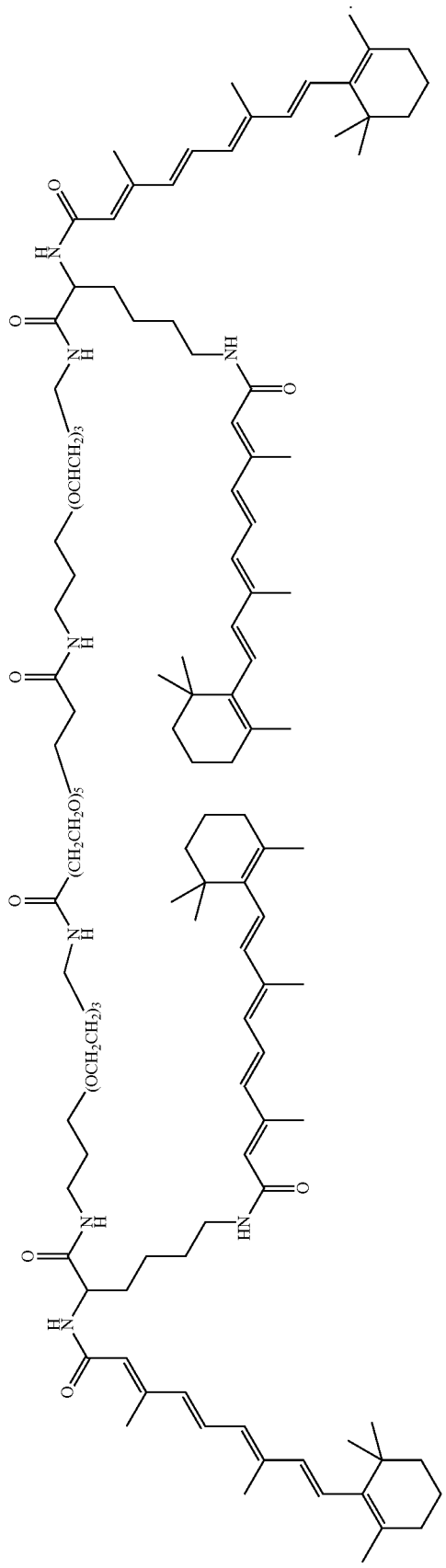

9. The pharmaceutical composition of claim 1, which is a liposomal composition.

10. The pharmaceutical composition of claim 1, wherein the retinoid is 0.1 mol % to 20 mol % of the lipid.

11. A pharmaceutical composition comprising a drug carrier and a double-stranded nucleic acid molecule, wherein the drug carrier comprises a lipid and a compound for facilitating drug delivery to a target cell, wherein the lipid comprises a compound of formula I

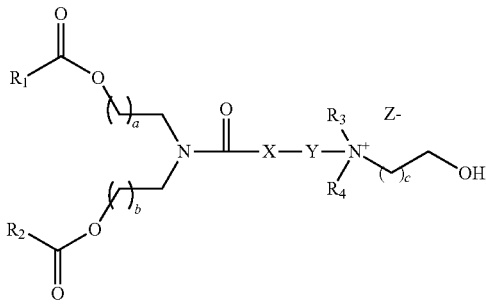

I wherein $R_1$ and $R_2$ is independently selected from a group consisting of $C_{10}$ to $C_{18}$ alkyl, $C_{12}$ to $C_{18}$ alkenyl, and oleyl group;

wherein $R_3$ and $R_4$ are independently selected from a group consisting of $C_1$ to $C_6$ alkyl, and C2 to C6 alkanol;

wherein X is selected from a group consisting of —$CH_2$—, —S—, and —O— or absent;

wherein Y is selected from —$(CH_2)_n$—, —$S(CH_2)_n$—, —$O(CH_2)_n$—, thiophene, —$SO_2(CH_2)_n$—, and ester, wherein n=1-4; a=1-4; b=1-4; and c=1-4;

wherein Z is a counterion; and wherein the double-stranded nucleic acid molecule is a modified nucleic acid molecule having the structure (A2) set forth below 5' N1-(N)x-Z 3' (antisense strand)

3' Z'—N2-(N')y-z'' 5' (sense strand)    (A2)

wherein each of N2 and N' is an unmodified or modified ribonucleotide, or an unconventional moiety;

wherein each of (N)x and (N')y is an oligonucleotide in which each consecutive N or N' is joined to the adjacent N or N' by a covalent bond, and wherein $(N)_x$ comprises at least one modified ribonucleotide among a multiplicity of unmodified or modified ribonucleotides, or unconventional moieties, N;

wherein each of x and y is independently an integer between 17 and 39;

wherein the sequence of (N')y has complementarity to the sequence of (N)x and (N)x has complementarity to a consecutive sequence in a target RNA;

wherein N1 is covalently bound to (N)x and is mismatched to the target RNA or is a complementary DNA moiety to the target RNA;

wherein N2 is covalently bound to (N')y and forms a base pair with N1;

wherein N1 is a moiety selected from the group consisting of natural or modified uridine, deoxyribouridine, ribothymidine, deoxyribothymidine, adenosine or deoxyadenosine;

wherein z'' may be present or absent, but if present is a capping moiety covalently attached at the 5'-terminus of N2-(N')y;

wherein each of Z and Z' is independently present or absent, but if present is independently 1-5 consecutive nucleotides, consecutive non-nucleotide moieties or a combination thereof covalently attached at the 3'-terminus of the strand in which it is present; and wherein (N)x comprises an antisense sequence to the mRNA coding sequence for human hsp47 exemplified by SEQ ID NO:1.

12. The pharmaceutical composition of claim 11, wherein the lipid is at a concentration of 5 mol % to 50 mol %.

13. The pharmaceutical composition of claim 11, wherein the lipid is selected from the group consisting of

HEDC-12

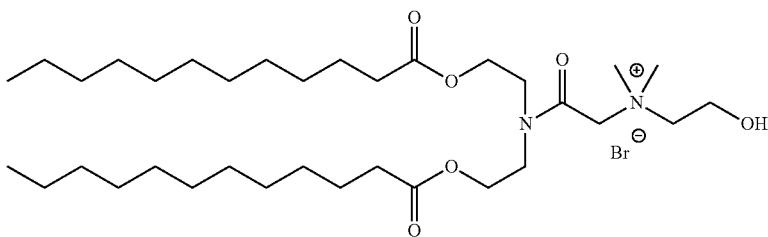

HEDC

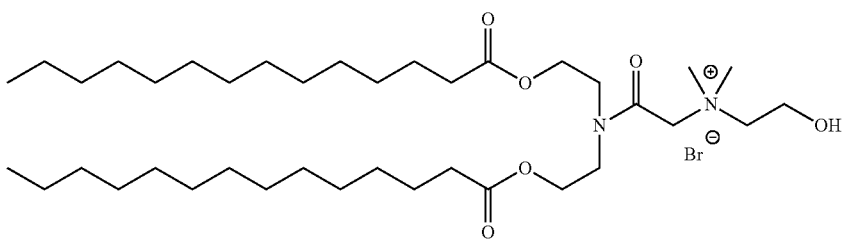

-continued
Pr-HEDC
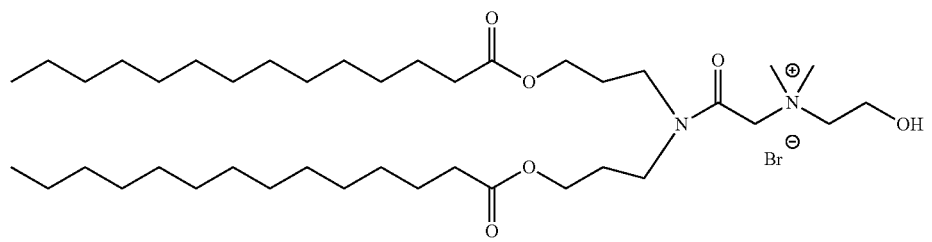
HE-Et-DC
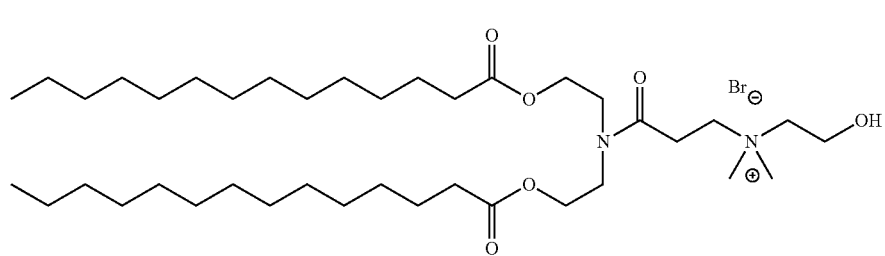
HE-Pr-DC
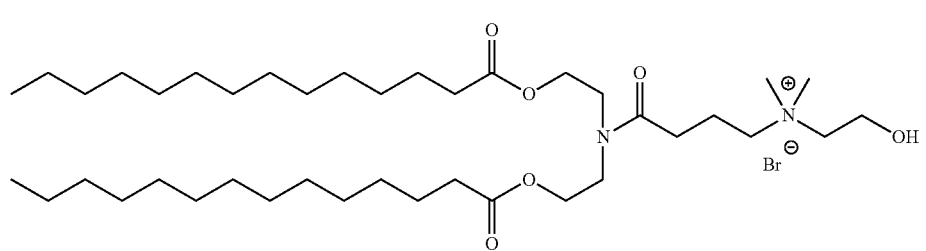
HES104
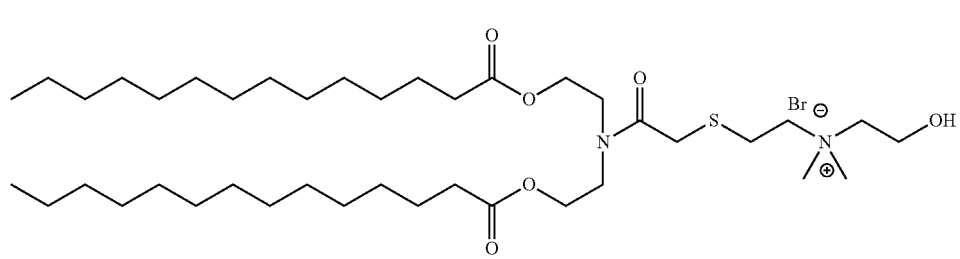
HE-DODC-DLin
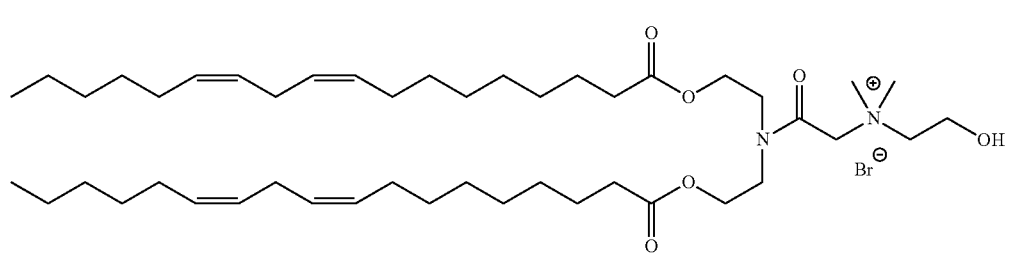
HE2-DODC
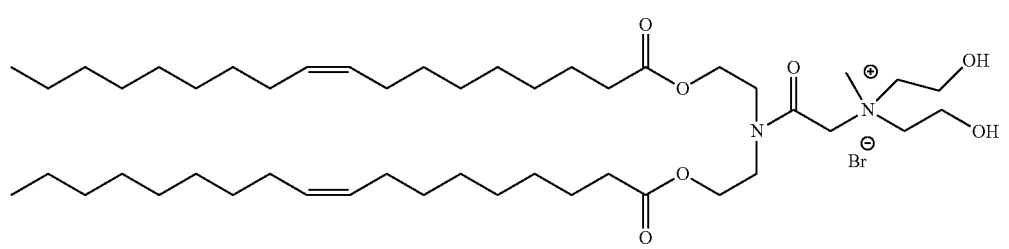

HE-DODC

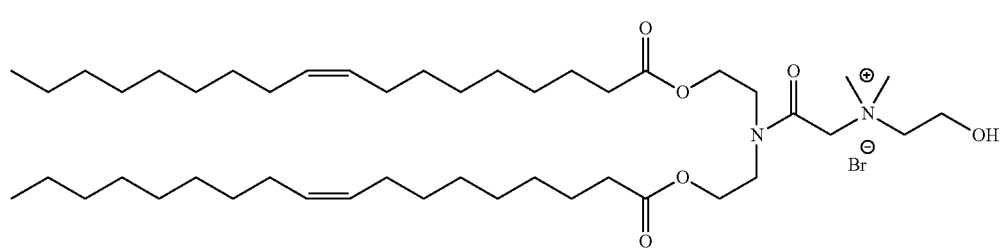

HE-Et-DODC

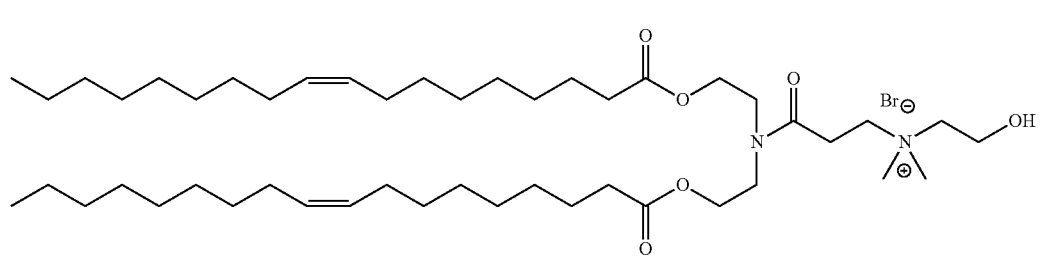

HE-Pr-DODC

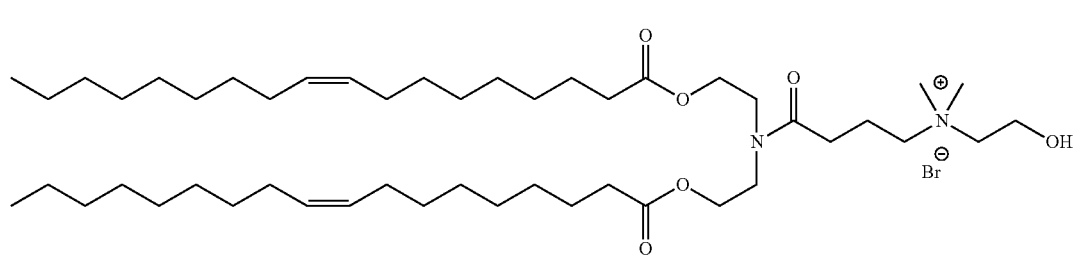

HES104DO

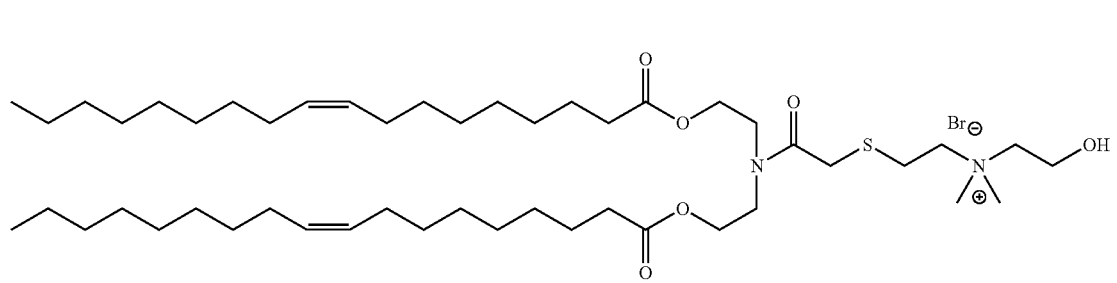

HETU104DO

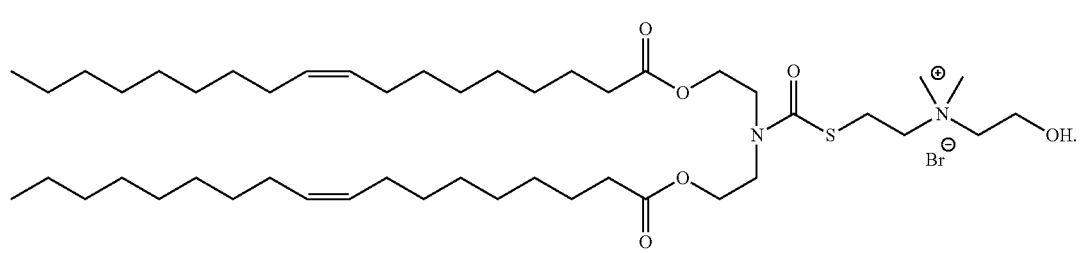

14. The pharmaceutical composition of claim 11, wherein the pharmaceutical composition further comprises a PEG-lipid.

15. The pharmaceutical composition of claim 14, wherein the PEG-lipid is at a concentration of 1 mol % to 10 mol %.

16. The pharmaceutical composition of claim 11, wherein the pharmaceutical composition further comprises an ionizable cationic lipid.

17. The pharmaceutical composition of claim 16, wherein the ionizable cationic lipid is

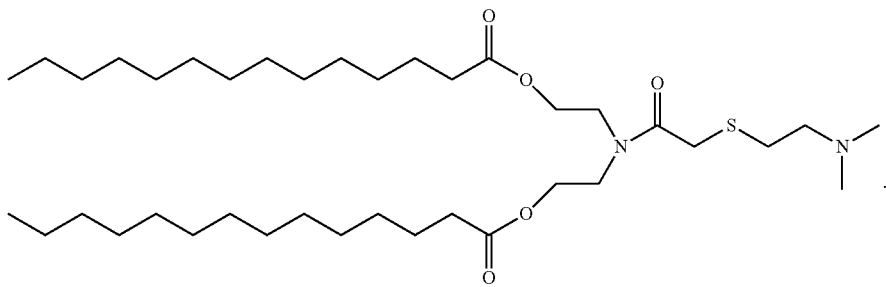

S104

18. The pharmaceutical composition of claim 16, wherein the ionizable cationic lipid is present at a concentration of 5 mol % to 45 mol %.

19. The pharmaceutical composition of claim 11, wherein the pharmaceutical composition further comprises a non-cationic lipid.

20. A pharmaceutical composition comprising a drug carrier and a double-stranded nucleic acid molecule, wherein the drug carrier comprises a lipid and a compound for facilitating drug delivery to a target cell, wherein the lipid is selected from the group consisting of

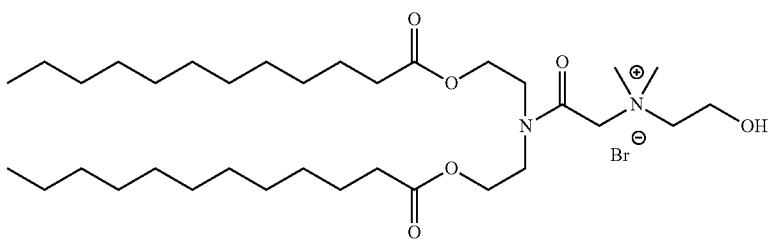

HEDC-12

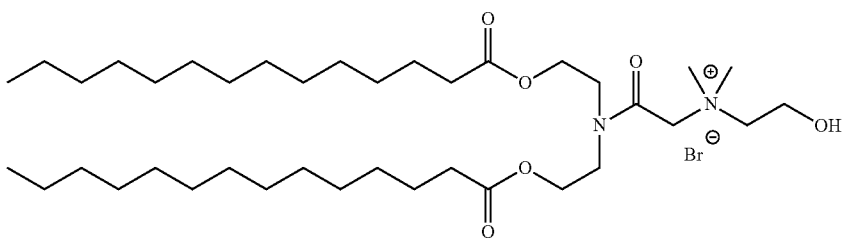

HEDC

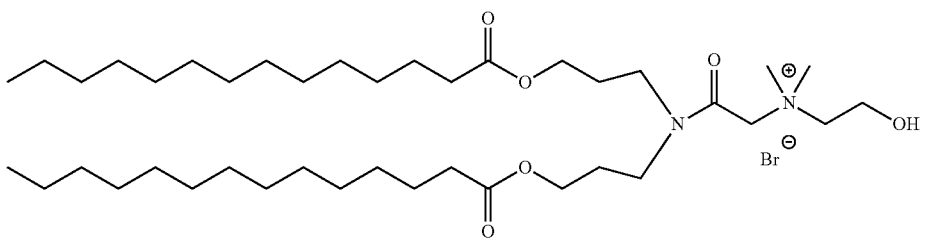

Pr-HEDC

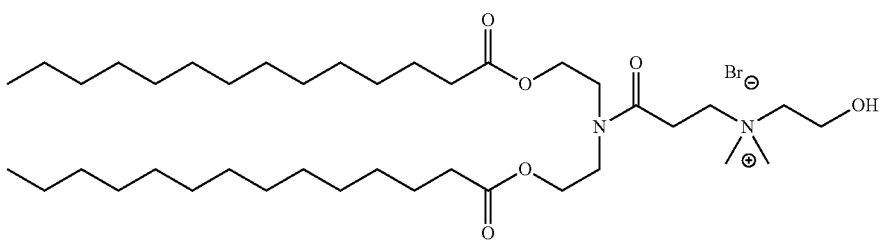

HE-Et-DC

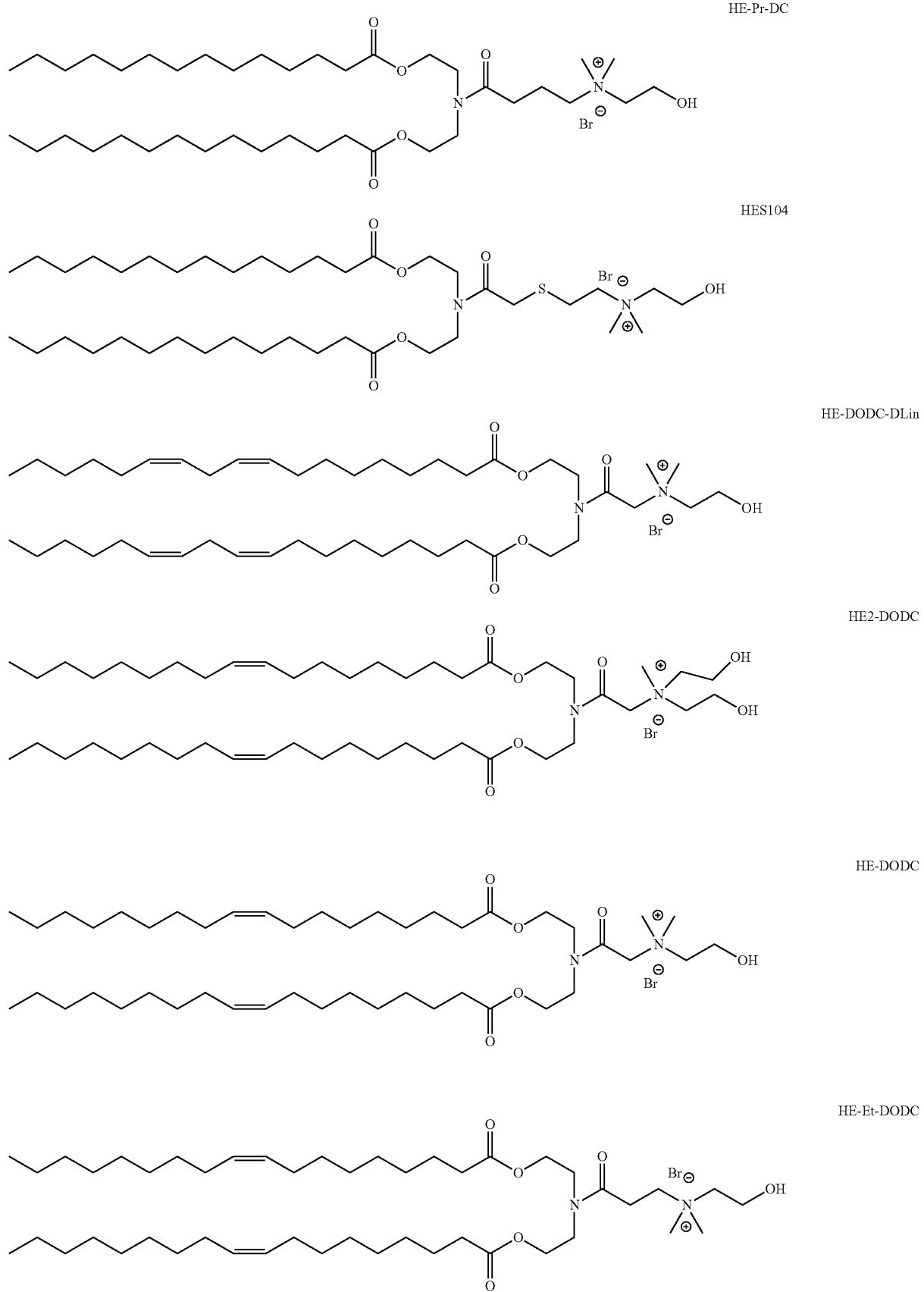

-continued
HE-Pr-DODC
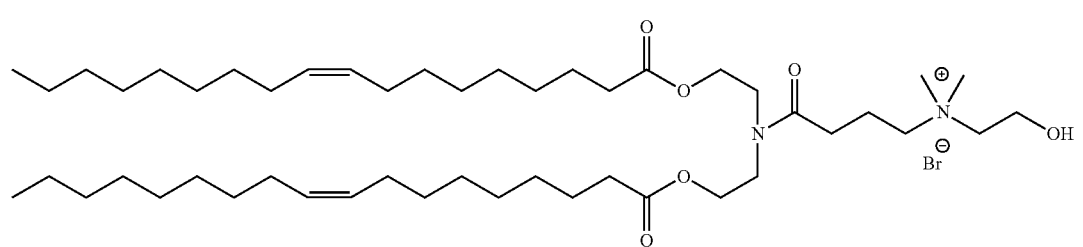
HES104DO
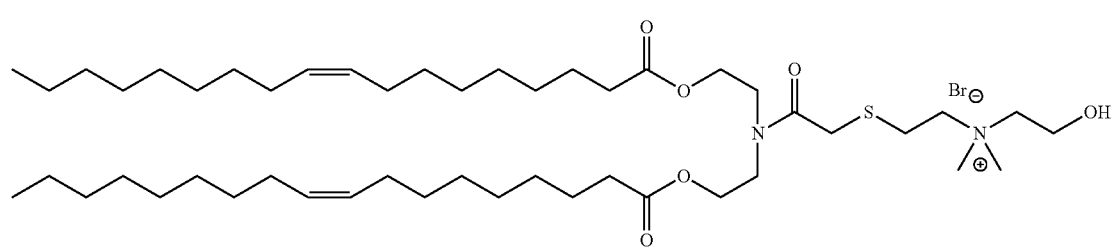
HETU104DO
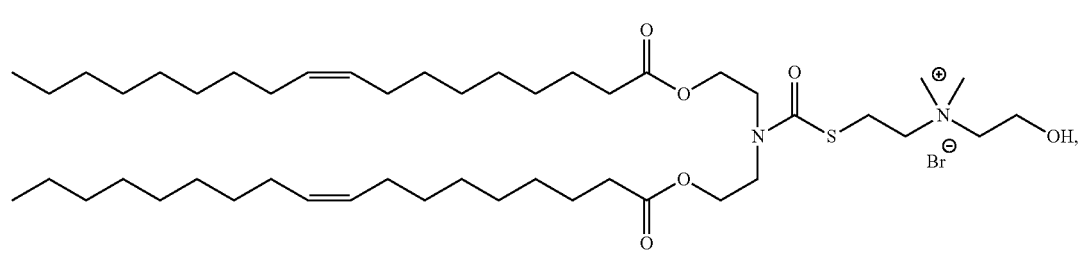
wherein the compound for facilitating drug delivery to a target cell has the structure of formula

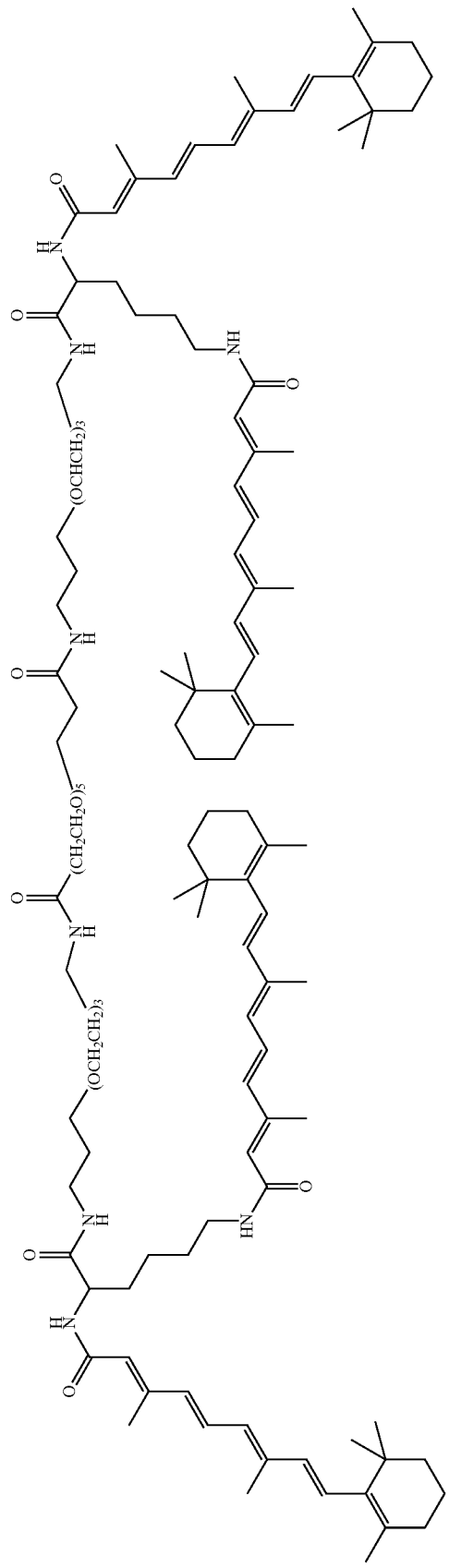

and wherein and wherein the double-stranded nucleic acid molecule is a the structure (A2) set forth below 5' N1-(N)x-Z 3' (antisense strand)

3' Z'—N2-(N')y-z" 5' (sense strand)     (A2)

wherein each of N2 and N' is an unmodified or modified ribonucleotide, or an unconventional moiety;

wherein each of (N)x and (N')y is an oligonucleotide in which each consecutive N or N' is joined to the adjacent N or N' by a covalent bond, and wherein $(N)_x$ comprises at least one modified ribonucleotide among a multiplicity of unmodified or modified ribonucleotides, or unconventional moieties, N;

wherein each of x and y is independently an integer between 17 and 39;

wherein the sequence of (N')y has complementarity to the sequence of (N)x and (N)x has complementarity to a consecutive sequence in a target RNA;

wherein N1 is covalently bound to (N)x and is mismatched to the target RNA or is a complementary DNA moiety to the target RNA;

wherein N2 is covalently bound to (N')y and forms a base pair with N1;

wherein N1 is a moiety selected from the group consisting of natural or modified uridine, deoxyribouridine, ribothymidine, deoxyribothymidine, adenosine or deoxyadenosine;

wherein z" may be present or absent, but if present is a capping moiety covalently attached at the 5'-terminus of N2-(N')y;

wherein each of Z and Z' is independently present or absent, but if present is independently 1-5 consecutive nucleotides, consecutive non-nucleotide moieties or a combination thereof covalently attached at the 3'-terminus of the strand in which it is present; and wherein (N)x comprises an antisense sequence to the mRNA coding sequence for human hsp47 exemplified by SEQ ID NO:1.

* * * * *

UNITED STATES PATENT AND TRADEMARK OFFICE
CERTIFICATE OF CORRECTION

PATENT NO. : 10,196,637 B2
APPLICATION NO. : 15/284494
DATED : February 5, 2019
INVENTOR(S) : Niitsu et al.

It is certified that error appears in the above-identified patent and that said Letters Patent is hereby corrected as shown below:

In the Claims

Under Claim no. 1, 11 and 20, Sense Strand of the Structure (A2) replace:
"3' Z'—N2-(N')y-z" 5'" with --3' Z'-N2-(N')y-z" 5'--

Under Claim no. 2, Column no. 165, Line no. 20 replace:
"The pharmaceutical composition of 1, wherein the" with --The pharmaceutical composition of claim 1, wherein the--

Under Claim no. 4, Column no. 166, Line no. 9 replace:
"PEG550, PEG-Glu, Glu, hexyl, Gly3, and 4-aminobutanoate" with --PEG550, PEG-Glu, Glu, hexyl, Gly$_3$, and 4-aminobutanoate--

Under Claim no. 6, Column no. 166, Line no. 17 replace:
"The pharmaceutical composition of 5, wherein the" with --The pharmaceutical composition of claim 5, wherein the--

Under Claim no. 7, Column no. 167, should read:

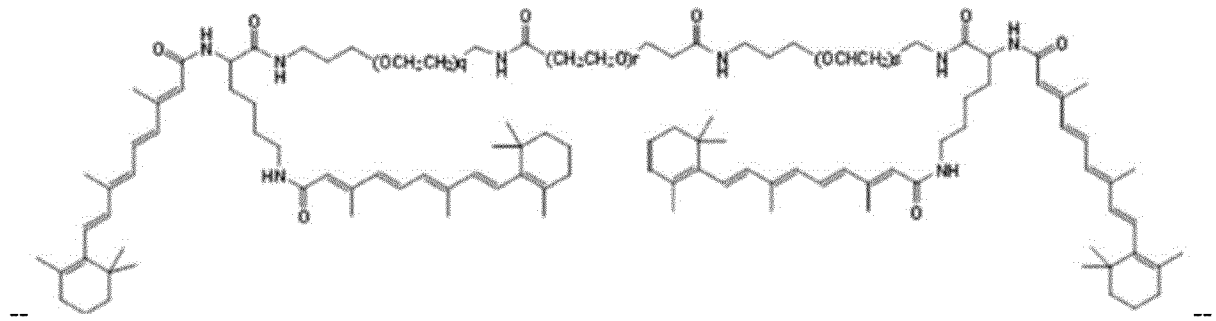

--                                                                                                                                   --

Signed and Sealed this
Third Day of March, 2020

Andrei Iancu
*Director of the United States Patent and Trademark Office*

Under Claim no. 20, Column no. 187, Line no. 1 replace:
"and wherein and wherein the double-stranded nucleic acid" with --and wherein the double-stranded nucleic acid--

Under Claim no. 20, Column no. 187, Line no. 2 replace:
"molecule is a the structure (A2) set forth below" with --molecule is the structure (A2) set forth below--